US008962563B2

(12) United States Patent
Dockal et al.

(10) Patent No.: US 8,962,563 B2
(45) Date of Patent: Feb. 24, 2015

(54) TFPI INHIBITORS AND METHODS OF USE

(71) Applicants: Baxter International Inc., Deerfield, IL (US); Baxter Healthcare SA, Glattpark (Opifkon (CH)

(72) Inventors: Michael Dockal, Vienna (AT); Rudolf Hartmann, Bisamberg (AT); Friedrich Scheiflinger, Vienna (AT); Frank Osterkamp, Berlin (DE); Thomas Polakowski, Berlin (DE); Ulrich Reineke, Berlin (DE)

(73) Assignees: Baxter International, Inc., Deerfield, IL (US); Baxter Healthcare SA, Glattpark (Opfikon) (CH)

( * ) Notice: Subject to any disclaimer, the term of this patent is extended or adjusted under 35 U.S.C. 154(b) by 0 days.

(21) Appl. No.: 13/756,036

(22) Filed: Jan. 31, 2013

(65) Prior Publication Data

US 2013/0252896 A1   Sep. 26, 2013

Related U.S. Application Data

(60) Provisional application No. 61/613,865, filed on Mar. 21, 2012.

(51) Int. Cl.
*A61K 38/36* (2006.01)
*A61P 7/02* (2006.01)
*C07K 14/745* (2006.01)
*C07K 14/00* (2006.01)
*C07K 7/08* (2006.01)
*A61K 38/00* (2006.01)

(52) U.S. Cl.
CPC ............... *C07K 14/001* (2013.01); *C07K 7/08* (2013.01); *A61K 38/00* (2013.01)
USPC ........................................................ 514/13.7

(58) Field of Classification Search
CPC ........................... A61K 38/00; A61K 39/3955
See application file for complete search history.

(56) References Cited

U.S. PATENT DOCUMENTS

| | | |
|---|---|---|
| 4,179,337 A | 12/1979 | Davis et al. |
| 4,301,144 A | 11/1981 | Iwashita et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 5,356,783 A | 10/1994 | Buonassisi et al. |
| 5,369,038 A | 11/1994 | Koike et al. |
| 5,399,363 A | 3/1995 | Liversidge et al. |
| 5,439,686 A | 8/1995 | Desai et al. |
| 5,466,468 A | 11/1995 | Schneider et al. |
| 5,498,421 A | 3/1996 | Grinstaff et al. |
| 5,576,294 A | 11/1996 | Norris et al. |
| 5,622,988 A | 4/1997 | Worsaae et al. |
| 5,629,176 A | 5/1997 | Børn et al. |
| 5,849,703 A | 12/1998 | Wun |
| 5,902,582 A | 5/1999 | Hung |
| 5,997,864 A | 12/1999 | Hart et al. |
| 6,113,896 A | 9/2000 | Lazarus et al. |
| 6,171,587 B1 | 1/2001 | Wun et al. |
| 6,180,607 B1 | 1/2001 | Davies et al. |
| 6,183,743 B1 | 2/2001 | Hart et al. |
| 6,262,233 B1 | 7/2001 | Gentz et al. |
| 6,548,262 B2 | 4/2003 | Gentz et al. |
| 6,916,629 B2 | 7/2005 | Gentz et al. |
| 7,015,194 B2 | 3/2006 | Kjalke |
| 8,450,275 B2 | 5/2013 | Dockal et al. |
| 8,466,108 B2 | 6/2013 | Dockal et al. |
| 2003/0040480 A1 | 2/2003 | Rojkjaer |
| 2003/0045498 A1 | 3/2003 | Kovesdi et al. |
| 2003/0059474 A1 | 3/2003 | Scott et al. |
| 2003/0064033 A1 | 4/2003 | Brown et al. |
| 2003/0092627 A1 | 5/2003 | Petersen et al. |
| 2003/0118574 A1 | 6/2003 | Rojkjaer |
| 2003/0124132 A1 | 7/2003 | Thorpe et al. |
| 2003/0129193 A1 | 7/2003 | Thorpe et al. |
| 2003/0139374 A1 | 7/2003 | Thorpe et al. |
| 2003/0211075 A1 | 11/2003 | Thorpe et al. |
| 2004/0018516 A1 | 1/2004 | Francischetti et al. |
| 2004/0043077 A1 | 3/2004 | Brown |
| 2004/0259768 A1 | 12/2004 | Lauermann |
| 2005/0032690 A1 | 2/2005 | Rojkjaer et al. |
| 2005/0048127 A1 | 3/2005 | Brown et al. |
| 2005/0142201 A1 | 6/2005 | Rashba-Step et al. |

(Continued)

FOREIGN PATENT DOCUMENTS

| | | |
|---|---|---|
| EP | 0507039 | 10/1992 |
| EP | 0539975 | 5/1993 |

(Continued)

OTHER PUBLICATIONS

Bajaj et al., Thromb Haemost, 2001, 86: 959-72.*
Atkins, Physical Chemistry, Third edition.*
Atkins, Physical Chemistry, Third edition, 1986.*
Adams et al., Anti-tissue factor pathway inhibitor activity in patients with primary antiphospholipid syndrome. *Br. J. Haematol.* 114(2): 375-9 (2001).
Audu et al., The impact of tissue factor pathway inhibitor on coagulation kinetics determined by thrombelastography. *Anesth. Analg.*, 103(4): 841-5 (2006).
Bi et al., Targeted disruption of the mouse factor VIII gene produces a model of haemophilia A. *Nat. Genet.*, 10(1): 119-21 (1995).

(Continued)

*Primary Examiner* — Marcela M Cordero Garcia
*Assistant Examiner* — Kaipeen Yang
(74) *Attorney, Agent, or Firm* — Marshall, Gerstein & Borun LLP

(57) ABSTRACT

The invention provides peptides that bind Tissue Factor Pathway Inhibitor (TFPI), including TFPI-inhibitory peptides, and compositions thereof. Peptide complexes also are provided. The peptides may be used to inhibit a TFPI, enhance thrombin formation in a clotting factor-deficient subject, increase blood clot formation in a subject, treat a blood coagulation disorder in a subject, purify TFPI, and identify a TFPI-binding compound.

21 Claims, 274 Drawing Sheets

(56) References Cited

U.S. PATENT DOCUMENTS

| | | | |
|---|---|---|---|
| 2005/0142205 A1 | 6/2005 | Rashba-Step et al. |
| 2005/0142206 A1 | 6/2005 | Brown et al. |
| 2005/0147689 A1 | 7/2005 | Egilmez |
| 2005/0170005 A1 | 8/2005 | Rashba-Step et al. |
| 2005/0181978 A1 | 8/2005 | Rojkjaer et al. |
| 2005/0214836 A1 | 9/2005 | Nakamura et al. |
| 2005/0233945 A1 | 10/2005 | Brown et al. |
| 2005/0282771 A1 | 12/2005 | Johnson |
| 2006/0024379 A1 | 2/2006 | Brown et al. |
| 2006/0040896 A1 | 2/2006 | Kennedy |
| 2006/0198837 A1 | 9/2006 | Morrissey et al. |
| 2006/0199766 A1 | 9/2006 | Petersen et al. |
| 2006/0205036 A1 | 9/2006 | Ostergaard et al. |
| 2006/0260777 A1 | 11/2006 | Rashba-Step et al. |
| 2007/0027077 A1 | 2/2007 | Rojkjaer |
| 2007/0092452 A1 | 4/2007 | Rashba-Step et al. |
| 2007/0192036 A1 | 8/2007 | Jojic et al. |
| 2007/0207210 A1 | 9/2007 | Brown et al. |
| 2007/0280920 A1 | 12/2007 | Petersen et al. |
| 2007/0281031 A1 | 12/2007 | Yang |
| 2008/0026068 A1 | 1/2008 | Brown et al. |
| 2008/0038307 A1 | 2/2008 | Hoffmann |
| 2008/0044852 A1 | 2/2008 | Kanayinkal et al. |
| 2008/0058266 A1 | 3/2008 | Rojkjaer |
| 2008/0161425 A1 | 7/2008 | Hackeng et al. |
| 2008/0187595 A1 | 8/2008 | Jordan et al. |
| 2008/0199506 A1 | 8/2008 | Horres et al. |
| 2009/0054837 A1 | 2/2009 | Von Holst et al. |
| 2009/0098119 A1 | 4/2009 | Lu et al. |
| 2009/0130086 A1 | 5/2009 | Roejkjaer et al. |
| 2009/0232866 A1 | 9/2009 | Pavone-Gyongyosi et al. |
| 2009/0269325 A1 | 10/2009 | Johnson |
| 2010/0008935 A1 | 1/2010 | Borlak et al. |
| 2010/0010946 A1 | 1/2010 | De Winter et al. |
| 2010/0173847 A1 | 7/2010 | Dockal et al. |

FOREIGN PATENT DOCUMENTS

| | | |
|---|---|---|
| EP | 1403638 | 3/2004 |
| EP | 1593389 | 11/2005 |
| FR | 2934052 | 1/2010 |
| JP | 4252954 | 9/1992 |
| JP | 6007193 | 1/1994 |
| JP | 6153985 | 6/1994 |
| JP | 2000128803 | 5/2000 |
| JP | 2002097200 | 4/2002 |
| JP | 2005306875 | 11/2005 |
| WO | WO-92/07584 | 5/1992 |
| WO | WO-93/14120 | 7/1993 |
| WO | WO-93/14121 | 7/1993 |
| WO | WO-93/14122 | 7/1993 |
| WO | WO-93/14123 | 7/1993 |
| WO | WO-94/02172 | 2/1994 |
| WO | WO-95/12674 | 5/1995 |
| WO | WO-95/18830 | 7/1995 |
| WO | WO-96/20278 | 7/1996 |
| WO | WO-96/28153 | 9/1996 |
| WO | WO-97/09063 | 3/1997 |
| WO | WO-97/23509 | 7/1997 |
| WO | WO-97/47651 | 12/1997 |
| WO | WO-98/33920 | 8/1998 |
| WO | WO-99/42119 | 8/1999 |
| WO | WO-01/07070 | 2/2001 |
| WO | WO-01/36472 | 5/2001 |
| WO | WO-01/85198 | 11/2001 |
| WO | WO-01/85199 | 11/2001 |
| WO | WO-01/87323 | 11/2001 |
| WO | WO-03/007983 | 1/2003 |
| WO | WO-03/028840 | 4/2003 |
| WO | WO-03/039579 | 5/2003 |
| WO | WO-2004/021861 | 3/2004 |
| WO | WO-2004/056384 | 7/2004 |
| WO | WO-2004/063337 | 7/2004 |
| WO | WO-2004/092410 | 10/2004 |
| WO | WO-2005/024006 | 3/2005 |
| WO | WO-2005/029089 | 3/2005 |
| WO | WO-2005/049070 | 6/2005 |
| WO | WO-2005/051985 | 6/2005 |
| WO | WO-2005/107795 | 11/2005 |
| WO | WO-2005/115442 | 12/2005 |
| WO | WO-2005/117912 | 12/2005 |
| WO | WO-2005/123916 | 12/2005 |
| WO | WO-2006/008267 | 1/2006 |
| WO | WO-2006/023397 | 3/2006 |
| WO | WO-2005/032611 | 6/2006 |
| WO | WO-2006/089966 | 8/2006 |
| WO | WO-2006/096345 | 9/2006 |
| WO | WO-2006/128497 | 12/2006 |
| WO | WO-2007/014749 | 2/2007 |
| WO | WO-2007/072012 | 6/2007 |
| WO | WO-2007/127834 | 11/2007 |
| WO | WO-2007/127841 | 11/2007 |
| WO | WO-2008/022806 | 2/2008 |
| WO | WO-2008/087488 | 7/2008 |
| WO | WO-2008/103234 | 8/2008 |
| WO | WO-2008/117179 | 10/2008 |
| WO | WO-2008/127654 | 10/2008 |
| WO | WO-2009/042962 | 4/2009 |
| WO | WO-2009/061697 | 5/2009 |
| WO | WO-2009/080054 | 7/2009 |
| WO | WO-2010/007140 | 1/2010 |
| WO | WO-2010/015668 | 2/2010 |
| WO | WO-2010/016634 | 2/2010 |
| WO | WO-2010/017196 | 2/2010 |
| WO | WO-2010/071894 | 6/2010 |
| WO | WO 2010071894 A2 * | 6/2010 |
| WO | WO-2011/115712 | 9/2011 |
| WO | WO-2012/135671 | 10/2012 |

OTHER PUBLICATIONS

Cawthern et al., Blood coagulation in hemophilia A and hemophilia C. *Blood*, 91(12): 4581-92 (1998).

Davis et al., Preparation and characterization of antibodies with specificity for the amino-terminal, tetrapeptide sequence of the platelet-derived connective tissue activating peptide-III. *Biochem. Intl.*, 10: 394-414 (1985).

Dockal et al., Peptides binding to Kunitz domain 1 of Tissue Factor Pathway Inhibitor (TFPI) inhibit all functions of TFPI and improve thrombin generation of hemophilia plasma. *Blood*, 118(21): 976-7 (2011).

Erhardtsen et al., Blocking of tissue factor pathway inhibitor (TFPI) shortens the bleeding time in rabbits with antibody induced haemophilia A. *Blood Coagul. Fibrinolysis*, 6(5): 388-95 (1995).

Gerhard et al., The status, quality, and expansion of the NIH full-length cDNA project: The mammalian gene collection (MGC). *Genome Res.*, 14(10B): 2121-7 (2004).

Girard et al., "Functional Significance of the Kunitz-type Inhibitory Domains of Lipoprotein-Associated Coagulation Inhibitor", *Nature*, 338:518-520 (1989).

Hedner et al., Tissue factor and factor VIIa as therapeutic targets in disorders of hemostasis. *Annu. Rev. Med.* 59: 29-41 (2007).

Hemker et al., Calibrated automated thrombin generation measurement in clotting plasma. *Pathophysiol. Haemost. Thromb.* 33: 4-15 (2003).

Horie et al., "Oxidized low-density lipoprotein impairs the anti-coagulant function of tisuse-factor-pathway inhibitor through oxidative modification by its high association and accelerated degradation in cultured human endothelial cells", *Biochemical Journal*, 352(2):277-285 (2000).

Jian et al., Cloning, expression and characterization of translationally controlled tumor protein (TCTP) gene from flatfish turbot (*Scophthalmus maximus*). J. Ocean Univ. China, 7(2): 184-92 (2008).

Johnson et al., The genome sequence of avian pathogenic *Escherichia coli* strain 01: K1: H7 shares strong similarities with human extraintestinal pathogenic *E-coli* genomes. *J. Bacteriology*, 189(8): 3228-36 (2007).

Larsen et al., The Merrifield peptide synthesis studied by near-infrared Fourier-tranform Raman spectroscopy. *J. Am. Chem. Soc.*, 115: 6247 (1993).

(56) References Cited

OTHER PUBLICATIONS

Lean et al., The effects of tissue factor pathway inhibitor and anti-b-2-glycoprotein-I IgG on thrombin generation. *Haematologica*, 91: 1360-6 (2006).

Lindhout et al., Kinetics of the inhibition of tissue factor-factor VIIa by tissue factor pathway inhibitor. *Thromb. Haemost.* 74: 910-5 (1995).

Liu et al., Improved coagulation in bleeding disorders by non-anticoagulant sulfated polysaccharides (NASP). *Thromb. Haemost.* 95: 68-76 (2006).

Liu et al., Optimized synthesis of RNA-protein fusions for invitro protein selection. *Methods Enzymol.* 318: 268-93 (2000).

Lozier et al., The chapel hill hemophilia a dog colony exhibits a factor VII gene inversion. *Proc. Natl. Acad. Sci. USA.* 99: 12991-6 (2002).

Mace et al., Functional linkage between the active site of α-lytic protease and distant regions of structure: Scanning alanine mutagenesis of a surface loop affects activity and substrate specificity. *J. Molec. Biol.*, 251: 116-34 (1995).

Mackman et al., Role of the extrinsic pathway of blood coagulation in hemostasis and thrombosis. *Arterioscler. Thromb. Vasc. Biol.*, 27, 1687-93 (2007).

Merrifield, Solid phase peptide synthesis. I. The synthesis of a tetrapeptide. *J. Am. Chem. Soc.*, 85: 2149-54 (1963).

Meziere et al, In vivo T helper cell response to retro-inverso peptidomimetics. *J. Immunol.*, 159: 3230-7 (1997).

Nakabachi et al., The 160-kilobase genome of the bacterial endosymbiont *Carsonella. Science*, 314: 267 (2006).

O'Donnell et al., Solid-phase unnatural peptide synthesis (UPS). *J. Am. Chem. Soc.*, 118: 6070 (1996).

Panteleev et al., Tissue factor pathway inhibitor: A possible mechanism of action. *Eur. J. Biochem.* 249: 2016-31 (2002).

Peerlinck et al., Epidemiology of inhibitor formation with recombinant factor VIII replacement therapy. *Haemophilia*, 12: 579-90 (2006).

Piro et al., Role for the Kunitz-3 domain of tissue factor pathway inhibitor-in cell surface binding. *Circulation*, 110: 3567-72 (2004).

Ruf et al., "Neutrophils release brakes of coagulation", *Nature Medicine*, 16(8):851-852 (2010).

Salemink et al., Antibodies to beta2-glycoprotein I associated with antiphospholipid syndrome suppress the inhibitory activity of tissue factor pathway inhibitor. *Thromb. Haemost.* 84(4): 653-6 (2008).

Shen et al., the effects of injection of human factor VIII antibody into rabbits. *Blood*, 42(4): 509-521 (1973).

Smith et al., Solid-phase peptide synthesis and biological activity of bovine thymopoietin II (bTP-II). *Int. J. Pept. Protein Res.* 44: 183-91 (1994).

Sprecher et al., Molecular cloning, expression, and partial characterization of a second human tissue-factor-pathway inhibitor. *Proc. Natl. Acad. Sci. USA.* 91: 3353-7 (1994).

Tang et al., Sepsis-induced coagulation in the baboon lung is associated with decreased tissue factor pathway inhibitor. *Am. J. Pathol.* 171(3): 1066-77 (2007).

Tranholm et al., Improved hemostasis with superactive analogs of factor VIIa in a mouse model of hemophilia A. *Blood*, 102: 3615-20 (2003).

UniProt Database Accession No. A1ACU8, Putative uncharacterized protein, dated Jan. 23, 2007.

UniProt Database Accession No. Q20216, Translationally-controlled tumor protein homolog, dated Apr. 18, 2006.

UniProt Database Accession No. Q99M74, Keratin, type II cuticular Hb2, dated Mar. 29, 2004.

Wang et al., A factor IX-deficient mouse model for hemophilia B gene therapy. *Proc. Natl. Acad. Sci. USA.* 94(21): 11563-66 (1997).

Yang et al., Preparation and characterization of monoclonal antibody against recombinant human tissue factor pathway inhibitor. *Chin. Med. J.* 111(8): 718-21 (1998).

Yun et al., Proteolytic inactivation of tissue factor pathway inhibitor by bacterial omptims. *Blood*, 113(5): 1139-48 (2008).

International Search Report and Written Opinion of the International Searching Authority, PCT/US2009/69060, United States Patent and Trademark Office, dated Jul. 28, 2010.

International Preliminary Report on Patentability issued in connection with International Application No. PCT/US2009/069060, dated Jun. 21, 2011.

International Search Report and Written Opinion of the International Searching Authority, PCT/US2011/024604, European Searching Authority, dated Sep. 14, 2011.

International Preliminary Report on Patentability issued in connection with International Application No. PCT/US2011/024604, dated Sep. 25, 2012.

Supplementary European Search Report, European Patent Application No. 09833887.4, mailed Aug. 8, 2012.

International Search Report and Written Opinion of the International Searching Authority, PCT/US2013/024167, European Searching Authority, dated May 16, 2013.

International Preliminary Report on Patentability issued in connection with PCT/US2013/024167, European Searching Authority, dated Oct. 2, 2014.

\* cited by examiner

| Base Sequence JBT0293 | FQSKKNVFVFGYFERLRAKL | (SEQ ID NO: 256) |
|---|---|---|
| JBT0294 | Ac-YQSKKNVFVFGYFERLRAKL-NH2 | (SEQ ID NO: 257) |
| JBT0295 | Ac-FSSKKNVFVFGYFERLRAKL-NH2 | (SEQ ID NO: 713) |
| JBT0296 | Ac-FQNKKNVFVFGYFERLRAKL-NH2 | (SEQ ID NO: 407) |
| JBT0297 | Ac-FQSKNNVFVFGYFERLRAKL-NH2 | (SEQ ID NO: 183) |
| JBT0298 | Ac-FQSKQNVFVFGYFERLRAKL-NH2 | (SEQ ID NO: 747) |
| JBT0299 | Ac-FQSKKNVFAFGYFERLRAKL-NH2 | (SEQ ID NO: 408) |
| JBT0300 | Ac-FQSKKNVFSFGYFERLRAKL-NH2 | (SEQ ID NO: 409) |
| JBT0301 | Ac-FQSKKNVFTFGYFERLRAKL-NH2 | (SEQ ID NO: 410) |
| JBT0302 | Ac-FQSKKNVFVAGYFERLRAKL-NH2 | (SEQ ID NO: 258) |
| JBT0303 | Ac-FQSKKNVFVDGYFERLRAKL-NH2 | (SEQ ID NO: 184) |
| JBT0304 | Ac-FQSKKNVFVLGYFERLRAKL-NH2 | (SEQ ID NO: 259) |
| JBT0305 | Ac-FQSKKNVFVQGYFERLRAKL-NH2 | (SEQ ID NO: 260) |
| JBT0306 | Ac-FQSKKNVFVSGYFERLRAKL-NH2 | (SEQ ID NO: 185) |
| JBT0307 | Ac-FQSKKNVFVYGYFERLRAKL-NH2 | (SEQ ID NO: 261) |
| JBT0308 | Ac-FQSKKNVFVFGYKERLRAKL-NH2 | (SEQ ID NO: 411) |
| JBT0309 | Ac-FQSKKNVFVFGYYERLRAKL-NH2 | (SEQ ID NO: 412) |
| JBT0310 | Ac-FQSKKNVFVFGYFDRLRAKL-NH2 | (SEQ ID NO: 262) |
| JBT0311 | Ac-FQSKKNVFVFGYFERLRAKN-NH2 | (SEQ ID NO: 748) |

FIGURE 4

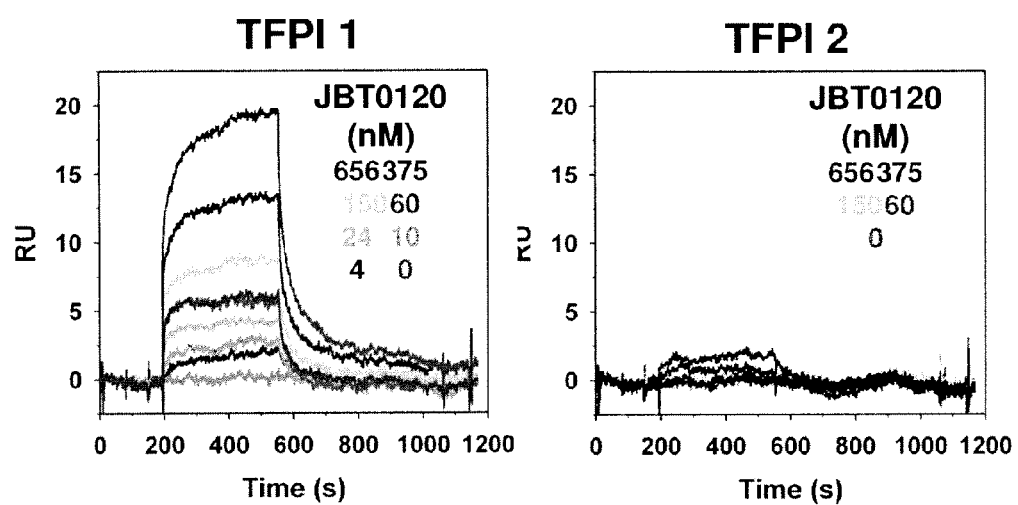
FIGURE 10A                    FIGURE 10B

FIG. 12A

| JBT-0047 | | Progress Curves of Inhibition of FXa | | | Extrinsic Tenase Inhibition by TFPI | | Factor IIa Generation | | | |
|---|---|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0047 | Ac-SGVGRLQVAFQSKKNVFVFGYFERLRAKLTS-NH2 (SEQ ID NO: 253) | --- | | NA | --- | NA | 123 | 122 | |
| | | --- | | NA | 1.23 | NA | | | |
| | | --- | | NA | --- | NA | | | |
| | | --- | | NA | 2.98 | 16 | | | |
| | | 0.72 | 82.4 | 68 | | | | | |
| | | --- | | NA | | | | | |
| | | | | 49 | | | | | |
| JBT0047 | Ac-SGVGRLQVAFQSKKNVFVFGYFERLRAKLTS-NH2 (SEQ ID NO: 253) | --- | | NA | 1.37 | 20 | 128 | 289 | 68 |
| | | 1.33 | 63.10 | 35 | 1.46 | 26 | | | |
| | | | | | | | 160 | | |
| | | | | | | | 155 | | |
| JBT0047 | Ac-SGVGRLQVAFQSKKNVFVFGYFERLRAKLTS-NH2*HCL (SEQ ID NO: 253) | | | | | | | | |
| JBT0051 | Biotin-Ttds-SGVGRLQVAFQSKKNVFVFGYFERLRAKLTS- | --- | | NA | 2.49 | NA | | | |

FIG. 12B

| JBT-0047 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | NH2 (SEQ ID NO: 962) | | | | | | | | |
| JBT0055 | Ac-SGVGRLQVAFQSKKNVFGYFERLRAKLTS-Ttds-Lysin(biotin)-NH2 (SEQ ID NO: 963) | 0.53 | 86.9 | 66 | 1.04 | 19 | | | |
| | | --- | | NA | --- | NA | | | |
| | | --- | | NA | --- | NA | | | |
| | | --- | | NA | --- | 18 | | | |
| | | 0.53 | 88.4 | 72 | 1.67 | 25 | | | |
| | | --- | | NA | | | | | |
| JBT0055 | Ac-SGVGRLQVAFQSKKNVFGYFERLRAKLTS-Ttds-Lysin(biotin)-NH2 (SEQ ID NO: 963) | --- | | NA | | | | | |
| JBT0131 | Biotin-Ttds-AFQSKKNVFGYFERLRAK-NH2 (SEQ ID NO: 964) | 8.20 | 77.80 | 23 | 2.02 | 11 | 65 | 173 | |
| JBT0131 | Biotin-Ttds-AFQSKKNVFGYFERLRAK-NH2*HCl (SEQ ID NO: 964) | 10.52 | 72.06 | 12 | 1.67 | 14 | 106 | 45 | |
| | | | | 14 | 2.96 | 14 | | | |
| JBT0132 | Biotin-Ttds-FQSKKNVFGYFERLRAKL-NH2 (SEQ ID NO: 965) | --- | | NA | 0.06 | 10 | 41 | 102 | |

FIG. 12C

| JBT-0047 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | | --- | 49.37 | 44 | --- | 16 | 28 | | |
| | | 1.15 | | 36 | | | | | |
| JBT0132 | Biotin-Ttds-FQSKKNVFVFGYFERLRAKL-NH2 (SEQ ID NO: 965) | --- | | 23 | | 11 | 109 | | |
| | | | | 27 | | 13 | 123 | 53 | |
| JBT0132 | Biotin-Ttds-FQSKKNVFVFGYFERLRAKLT-NH2 (SEQ ID NO: 965) | --- | | 30 | | 11 | 112 | | |
| JBT0133 | Biotin-Ttds-QSKKNVFVFGYFERLRAKLRAKL-NH2 (SEQ ID NO: 966) | --- | | NA | 0.34 | 9 | 117 | 67 | |
| | | | | 15 | | | 28 | | |
| JBT0134 | Biotin-Ttds-QSKKNVFVFGYFERLRAK-NH2 (SEQ ID NO: 967) | --- | | NA | --- | 3 | 11 | --- | |
| | | | | 5 | | | | | |
| JBT0155 | Ac-KKSGVGRLQVAFQSKKNVFVFGYFERLRAKL TSKK-NH2 (SEQ ID NO: 8) | --- | | 74 | 0.38 | 33 | 49 | | |
| | | 0.97 | 77.70 | 54 | | | 67 | | |
| JBT0156* | Ac-VVEKLTFVQLSFLNRRRFSQYAGFKGAGKV-NH2 (SEQ ID NO: 742) | --- | | 0 | --- | 18 | --- | | |

FIG. 12D

| JBT-0047 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0157* | Ac-RVFLYFSGKAGGLVKLVERQAFQTNVSKFR-NH2 (SEQ ID NO: 743) | --- | | | 1.49 | 14 | --- | | |
| JBT0158 | Ac-KKSGVGRLQVAFQSKKNVFVFGYFERLRAKK-NH2 (SEQ ID NO: 9) | --- | | 0 | --- | 12 | | | |
|  |  |  |  |  |  | 9 |  |  |  |
| JBT0159 | Ac-KKSGVGRLQVAFQSKKNVFVFGYFERLKK-NH2 (SEQ ID NO: 744) | 4.26 | 88.20 | 34 | --- | 9 | 30 | | |
|  |  |  |  | 35 |  | 23 |  |  |  |
| JBT0160 | Ac-KKSGVGRLQVAFQSKKNVFVFGYFKK-NH2 (SEQ ID NO: 745) | --- | | 0 | --- | 18 | inhib | | |
| JBT0161 | Ac-KKSGVGRLQVAFQSKKNVFVFKK-NH2 (SEQ ID NO: 746) | --- | | 0 | --- | 22 | inhib | | |
|  |  |  |  |  |  | 22 | inhib |  |  |
| JBT0162 | Ac-KKGRLQVAFQSKKNVFVFGYFERLRAKLTSK-NH2 (SEQ ID NO: 10) | 0.74 | 70.70 | 68 | 0.28 | 6 | 54 | | |
|  |  |  |  | 54 |  | 34 |  |  |  |

FIG. 12E

| JBT-0047 | | Progress Curves of Inhibition of FXa | | Extrinsic Tenase Inhibition by TFPI | | Factor IIa Generation | | | |
|---|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0163 | Ac-KKQVAFQSKKNVFVFGYFERLRAKLTSKK-NH2 (SEQ ID NO: 11) | --- | | 66 | 0.89 | 31 | 69 | | |
| JBT0164 | Ac-KKFQSKKNVFVFGYFERLRAKLTSKK-NH2 (SEQ ID NO: 12) | 1.54 | 79.30 | 48 | 2.68 | 24 | 39 | | |
| | | --- | | 55 | | | | | |
| | | --- | | 50 | | | | | |
| JBT0165 | Ac-KKKKNVFVFGYFERLRAKLTSKK-NH2 (SEQ ID NO: 712) | 1.74 | 71.24 | 43 | --- | 15 | inhib | | |
| JBT0166 | Biotinyl-Ttds-KKFQSKKNVFVFGYFERLRAKLKK-NH2 (SEQ ID NO: 968) | --- | | 71 | 1.95 | 36 | | | |
| | | --- | | 58 | | | | | |
| | | 2.60 | 85.60 | 50 | | | | | |
| JBT0167* | Biotinyl-Ttds-GKNAKFYLFESLRQVKFVFR-NH2 (SEQ ID NO: 969) | --- | | 0 | --- | 21 | --- | | |
| | | | | | --- | 19 | | | |
| | | | | | --- | 15 | | | |
| JBT0168* | Biotinyl-Ttds-YKFSFNKELFKQARLRFVGV-NH2 (SEQ ID NO: 970) | --- | | 0 | --- | 9 | --- | | |

FIG. 12F

| JBT-0047 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | $EC_{50}$ (μM) | % Inhibit (Max) | $EC_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0169 | Ac-KKAFQSKKNVFVFGYFERLRAKKK-NH2 (SEQ ID NO: 254) | --- | 16 | 2.35 | 20 | 21 | | |
| JBT0170 | Ac-KKFQSKKNVFVFGYFERLRAKLKK-NH2 (SEQ ID NO: 13) | --- | 21 61 49 43 | 1.90 | 30 | 68 | | |
| JBT0171 | Ac-KKQSKKNVFVFGYFERLRAKLTKK-NH2 (SEQ ID NO: 255) | --- | 25 29 | 4.12 | 13 | 33 | | |
| JBT0172 | Ac-KKQSKKNVFVFGYFERLRAKKK-NH2 (SEQ ID NO: 406) | --- | 7 14 | 3.98 | 8 | -- | | |
| JBT0173 | Biotinyl-Ttds-SGVGRLQVAFQSKKNVFVFG-NH2 (SEQ ID NO: 971) | --- | 0 | | 3 | 49 | | |
| JBT0174 | Ac-KKAFQSKKNVFVFGYFERLRAKLKK-NH2 (SEQ ID NO: 14) | --- | 47 39 | 2.90 | 26 | 49 | | |
| JBT0175 | Ac-KKAFQSKKNVFVFGYFERLRAKLTKK-NH2 (SEQ ID NO: 182) | --- | 45 | 2.29 | 26 | | | |

FIG. 12G

| JBT-0047 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | | 2.71 | 78.67 | 40 | | | | | |
| | | | | | --- | 1 | | | |
| | | | | | --- | 3 | | | |
| JBT0293 | Ac-FQSKKNVFGYFERLRAKL-NH2 (SEQ ID NO: 256) | --- | | 28 | 2.93 | 12 | 119 | | |
| | | 1.32 | 40.6 | 27 | --- | 14 | 147 | 71 | |
| | | 1.69 | 44.11 | 27 | --- | 13 | 135 | | |
| | | --- | | 29 | --- | 15 | 132 | | |
| JBT0293 | Ac-FQSKKNVFGYFERLRAKL-NH2 (SEQ ID NO: 256) | 1.94 | 39.5 | 22 | 1.62 | 16 | | | |
| | | 5.37 | 78.1 | 27 | | 16 | | | |
| JBT0294 | Ac-YQSKKNVFGYFERLRAKL-NH2 (SEQ ID NO: 257) | --- | | 26 | | 12 | 122 | | |
| | | 4.07 | 101.07 | 46 | 5.31 | 9 | 169 | 82 | |
| JBT0295 | Ac-FSSKKNVFGYFERLRAKL-NH2 (SEQ ID NO: 713) | --- | | 40 | | 13 | inhib | | |
| | | | | 2 | | 10 | | | |
| JBT0296 | Ac-FQNKKNVFGYFERLRAKL-NH2 (SEQ ID NO: 407) | | | 25 | 1.80 | 6 | 79 | | |
| | | 4.91 | 69.35 | 19 | 7.83 | 10 | | | |

FIG. 12H

| JBT-0047 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0297 | Ac-FQSKNNVFVFGYFERLRAKL-NH2 (SEQ ID NO: 183) | --- | | 67 | --- | 13 | 147 | | |
| | | 0.63 | 67.87 | 59 | --- | 14 | 206 | 113 | |
| | | 0.44 | 58.5 | 56 | --- | 7 | 170 | | |
| | | 1.1 | 60.6 | 41 | --- | 14 | 197 | | |
| JBT0298 | Ac-FQSKQNVFVFGYFERLRAKL-NH2 (SEQ ID NO: 747) | --- | | 45 | --- | 15 | 109 | | |
| | | 1.83 | 71.69 | 42 | --- | 17 | | | |
| JBT0299 | Ac-FQSKKNVFAFGYFERLRAKL-NH2 (SEQ ID NO: 408) | --- | | 13 | --- | 5 | 63 | | |
| | | 15.31 | 73.69 | 9 | --- | 6 | | | |
| JBT0300 | Ac-FQSKKNVFSFGYFERLRAKL-NH2 (SEQ ID NO: 409) | --- | | 7 | --- | 3 | 40 | | |
| JBT0301 | Ac-FQSKKNVFTFGYFERLRAKL-NH2 (SEQ ID NO: 410) | --- | | 9 | --- | 0 | 49 | | |
| JBT0302 | Ac-FQSKKNVFAGYFERLRAKL-NH2 (SEQ ID NO: 258) | --- | | 55 | --- | 3 | 220 | | |
| | | 2.10 | 90.94 | 47 | --- | 6 | 249 | 185 | |
| | | 2.6 | 68.2 | 33 | --- | 8 | 218 | | |
| JBT0303 | Ac-FQSKKNVFVDGYFERLRAKL-NH2 (SEQ ID NO: 184) | --- | | 61 | --- | 7 | 253 | | |

FIG. 12I

| JBT-0047 | | | | | | | | | |
|---|---|---|---|---|---|---|---|---|---|
| PEPTIDE | SEQUENCE | Progress Curves of Inhibition of FXa | | | Extrinsic Tenase Inhibition by TFPI | | Factor IIa Generation | | |
| | | EC₅₀ (µM) | % Inhibit (Max) | % Inhibit (2.5µM) | EC₅₀ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| | | 1.16 | 93.12 | 61 | --- | 8 | 250 | 218 | |
| | | 0.92 | 78.01 | 54 | --- | 7 | 244 | | |
| JBT0303 | Ac-FQSKKNVFVDGYFERLRAKL-NH2 (SEQ ID NO: 184) | 1.76 | 77.5 | 45 | 11.16 | 7 | 239 | | |
| JBT0304 | Ac-FQSKKNVFVLGYFERLRAKL-NH2 (SEQ ID NO: 259) | --- | | 35 | 8.8 | 9 | | | |
| JBT0305 | Ac-FQSKKNVFVQGYFERLRAKL-NH2 (SEQ ID NO: 260) | 2.95 | 75.15 | 32 | 12.87 | 7 | 138 | | |
| | | --- | | 46 | --- | 0 | 207 | | |
| | | 2.28 | 87.92 | 45 | --- | 5 | 223 | 205 | |
| | | 3.15 | 65.6 | 27 | --- | 4 | 207 | | |
| JBT0306 | Ac-FQSKKNVFVSGYFERLRAKL-NH2 (SEQ ID NO: 185) | --- | | 42 | --- | 3 | 197 | | |
| | | 3.56 | 94.28 | 37 | --- | 2 | 204 | 174 | |
| | | 3.89 | 71.4 | 28 | --- | 5 | 247 | | |
| JBT0307 | Ac-FQSKKNVFVYGYFERLRAKL-NH2 (SEQ ID NO: 261) | --- | | 38 | --- | 7 | 151 | | |
| | | 3.42 | 85.15 | 34 | 8.72 | 4 | 182 | 168 | |
| | | 3.01 | 60.2 | 26 | --- | 9 | 182 | | |
| JBT0308 | Ac-FQSKKNVFVFGYKERLRAKL-NH2 (SEQ ID | --- | | 9 | --- | 4 | 133 | | |

FIG. 12J

| JBT-0047 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | NO: 411) | | | | | | | | |
| JBT0309 | Ac-FQSKKNVFVFGYYERLRAKL-NH2 (SEQ ID NO: 412) | --- | | 21 | --- | 7 | 123 | | |
| JBT0310 | Ac-FQSKKNVFVFGYFDRLRAKL-NH2 (SEQ ID NO: 262) | 4.50 | 66.79 | 19 | 8.55 | 7 | 142 | | |
| | | 3.86 | 70.81 | 26 | 16.98 | 3 | 152 | | |
| | | 2.11 | 47.68 | 24 | --- | 4 | 163 | | |
| | | 3.37 | 48.8 | 19 | --- | 5 | | | |
| JBT0311 | Ac-FQSKKNVFVFGYFERLRAKN-NH2 (SEQ ID NO: 748) | 44.92 | 68.81 | 5 | 3.72 | 5 | 27 | | |
| JBT0335 | Ac-FQSKKNVFVFGYFERLRAK-NH2 (SEQ ID NO: 749) | 6.2 | 16.4 | 2 | 10.48 | 10 | 28 | | |
| JBT0336 | Ac-FQSKNNVFVAGYFDRLRAKL-OH (SEQ ID NO: 263) | 6.52 | 63 | 19 | 12.13 | 5 | 186 | | |
| | | | | | | | 181 | | |
| JBT0337 | Ac-FQSKNNVFVDGYFDRLRAKL-NH2 (SEQ ID NO: 16) | 0.71 | 69.1 | 51 | 13.33 | 15 | 219 | | |
| JBT0338 | Ac-FQSKNNVFVQGYFDRLRAKL-NH2 (SEQ ID NO: 17) | 1.12 | 60.9 | 40 | 8.42 | 9 | 197 | | |

FIG. 12K

| JBT-0047 | | | Progress Curves of Inhibition of FXa | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0339 | Ac-FQSKNNVFVSGYFDRLRAKL-NH2 (SEQ ID NO: 18) | 1.22 | 66.9 | 42 | 19.1 | 9 | 230 | | |
| JBT0340 | Ac-FQSKNNVFVYGYFDRLRAKL-NH2 (SEQ ID NO: 186) | 1.87 | 66 | 37 | 26.12 | 9 | 231 | | |
| JBT0341 | Ac-FQSKNNVFVFGYFDRLRAKL-NH2 (SEQ ID NO: 187) | 1.08 | 54.1 | 38 | 8.68 | 10 | 197 | | |
| JBT0342 | Ac-FQSKNNVFVDGYFERLRAKL-NH2 (SEQ ID NO: 19) | 0.38 | 65.8 | 58 | 7.15 | 18 | 193 | | |
| JBT0343 | Ac-FQSKKNVFVDGYFDRLRAKL-NH2 (SEQ ID NO: 188) | 1.08 | 54.1 | 34 | 42.24 | 8 | 244 | | |
| | | 2.21 | 82 | 42 | --- | 5 | 241 | | |
| JBT0374 | Ac-FQSKDNVFGYFERLRAKL-NH2 (SEQ ID NO: 20) | 0.64 | 56.9 | 49 | 20.22 | 19 | 239 | | |
| JBT0375 | Ac-FQSKGNVFVFGYFERLRAKL-NH2 (SEQ ID NO: 190) | --- | | 57 | --- | 14 | 216 | | |
| | | --- | | 70 | 2.93 | 30 | 224 | | |
| JBT0375 | Ac-FQSKGNVFVFGYFERLRAKL-NH2 (SEQ ID NO: 190) | 0.31 | 62.1 | 61 | | | | | |
| | | --- | | 53 | --- | 19 | | | |

FIG. 12L

| JBT-0047 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0376 | Ac-FQSKKNAFVFGYFERLRAKL-NH2 (SEQ ID NO: 414) | --- | | 11 | --- | 3 | 101 | | |
| JBT0377 | Ac-FQSKKNQFVFGYFERLRAKL-NH2 (SEQ ID NO: 264) | --- | | 20 | --- | 8 | 180 | | |
| JBT0378 | Ac-FQSKKNVFVEGYFERLRAKL-NH2 (SEQ ID NO: 21) | --- | | 41 | --- | 7 | 245 | | |
| JBT0379 | Ac-FQSKKNVFVTGYFERLRAKL-NH2 (SEQ ID NO: 22) | 1.59 | 79.1 | 44 | 9.03 | 12 | 226 | | |
| | | 3.13 | 81.8 | 36 | 47.85 ?? | 12 | 199 | | |
| JBT0380 | Ac-FQSKKNVFVVGYFERLRAKL-NH2 (SEQ ID NO: 191) | --- | | 27 | --- | 6 | | | |
| JBT0381 | Ac-FQSPKNVFVFGYFERLRAKL-NH2 (SEQ ID NO: 265) | 2.59 | 73.1 | 34 | 7.58 | 10 | 173 | | |
| | | no fit | | 34 | no fit | 11 | --- | | |
| JBT0385 | Ac-FQSKKNNFVFGYFERLRAKL-NH2 (SEQ ID NO: 672) | --- | | 0 | --- | 2 | 85 | | |
| JBT0386 | Ac-FQSKKNPFVFGYFERLRAKL-NH2 (SEQ ID NO: 415) | --- | | 6 | --- | 5 | 185 | | |
| JBT0388 | Ac-FQSKKNVHVFGYFERLRAKL-NH2 (SEQ ID | --- | | 25 | --- | 6 | | | |

FIG. 12M

| JBT-0047 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | $EC_{50}$ (μM) | % Inhibit (Max) | % Inhibit (2.5μM) | $EC_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | NO: 192) | | | | | | | | |
| JBT0389 | Ac-FQSKKNVVVFGYFERLRAKL-NH2 (SEQ ID NO: 673) | 4.34 | 72.5 | 26 | no fit | 9 | | | |
| JBT0390 | Ac-FQSKKNVFQFGYFERLRAKL-NH2 (SEQ ID NO: 674) | --- | | 0 | --- | 8 | 34 | | |
| JBT0391 | Ac-FQSKKNVFVGGYFERLRAKL-NH2 (SEQ ID NO: 266) | --- | | 0 | --- | 5 | 28 | | |
| | | 7.02 | 73.8 | 12 | --- | 1 | 178 | | |
| JBT0392 | Ac-FQSKKNVFVHGYFERLRAKL-NH2 (SEQ ID NO: 23) | --- | | 18 | --- | 1 | | | |
| | | | | 32 | --- | 4 | 228 | | |
| JBT0393 | Ac-FQSKKNVFVKGYFERLRAKL-NH2 (SEQ ID NO: 193) | 2.48 | 74.4 | 37 | --- | 6 | | | |
| | | --- | | 20 | --- | 3 | 268 | | |
| JBT0394 | Ac-FQSKKNVFVMGYFERLRAKL-NH2 (SEQ ID NO: 24) | 3.02 | 64.1 | 28 | --- | 1 | | | |
| | | --- | | 10 | --- | 7 | 115 | | |
| | | 6.83 | 57.3 | 12 | --- | 8 | | | |
| JBT0395 | Ac-FQSKKNVFVNGYFERLRAKL-NH2 (SEQ ID NO: 25) | --- | | 28 | --- | 7 | 235 | | |
| | | 2.80 | 72.1 | 32 | no fit | 7 | | | |

FIG. 12N

| JBT-0047 | | Progress Curves of Inhibition of FXa | | | Extrinsic Tenase Inhibition by TFPI | | Factor IIa Generation | | | |
|---|---|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0396 | Ac-FQSKKNVFVPGYFERLRAKL-NH2 (SEQ ID NO: 194) | --- | | 22 | --- | 6 | 196 | | |
| JBT0397 | Ac-FQSKKNVFVRGYFERLRAKL-NH2 (SEQ ID NO: 195) | 4.33 | 77.2 | 30 | 8.71 | 6 | 240 | | |
| JBT0398 | Ac-FQSKKNVFVFGYFEELRAKL-NH2 (SEQ ID NO: 196) | --- | | 24 | --- | 4 | | | |
| JBT0399 | Ac-FQSKKNVFVFGYFELLRAKL-NH2 (SEQ ID NO: 750) | 5.09 | 72.3 | 23 | 9.80 | 0 | | | |
| JBT0400 | Ac-FQSKKNVFVFGYFLRLRAKL-NH2 (SEQ ID NO: 267) | --- | | 4 | --- | 8 | --- | | |
| JBT0401 | Ac-FQSKKNVFVFGYFERLRAVL-NH2 (SEQ ID NO: 416) | --- | | 0 | --- | 7 | --- | | |
| JBT0402 | Biotin-Ttds-FQSKNNVFVFGYFERLRAKL-NH2 (SEQ ID NO: 973) | --- | | 1 | --- | 13 | --- | | |
| JBT0403 | Biotin-Ttds-FQSKKNVFVDGYFERLRAKL-NH2 (SEQ ID NO: 972) | 0.32 | 45.41 | 0 | --- | 4 | --- | | |
| | | 0.49 | 64.39 | 48 | --- | 11 | 185 | | |
| | | --- | | 59 | 3.38 | 9 | 253 | | |
| | | | | 62 | | 14 | | | |
| JBT0404 | Biotin-Ttds-FQSKKNVFVFGYFDRLRAKL-NH2 (SEQ ID NO: 974) | 1.89 | 42.89 | 24 | --- | 14 | 115 | | |
| JBT0405 | Biotin-FQSKKNVFVFGYFERLRAKL-NH2 | 0.86 | 81.33 | 59 | --- | 15 | 142 | | |

FIG. 12O

| JBT-0047 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | (SEQ ID NO: 975) | | | | | | | | |
| JBT0406 | Ac-Ttds-FQSKKNVFVFGYFERLRAKL-NH2 (SEQ ID NO: 268) | --- | | 28 | --- | 9 | 114 | | |

FIG. 13A

JBT-0049

| PEPTIDE | SEQUENCE | Progress Curves of Inhibition of FXa | | Extrinsic Tenase Inhibition by TFPI | | Factor IIa Generation | | |
|---|---|---|---|---|---|---|---|---|
| | | EC$_{50}$ (µM) | % Inhibit (Max) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0049 | Ac-SGNTFVDERLLYFLTIGNMGMYAAQLKFRTS-NH2 (SEQ ID NO: 3025) | --- | | --- | NA | | 12 | 12 |
| | | --- | | --- | 17 | 36 | 44 | |
| | | --- | | --- | 11 | | | |
| | | --- | | | | | | |
| | | | % Inhibit (2.5µM): 17 | | | | | |
| JBT0049 | Ac-SGNTFVDERLLYFLTIGNMGMYAAQLKFRTS-NH2 (SEQ ID NO: 3025) | --- | | --- | 13 | 49 | 17 | |
| | | | 10 | | 8 | 42 | | |
| | | | 19 | | | 53 | | |
| JBT0053 | Biotin-Ttds-SGNTFVDERLLYFLTIGNMGMYAAQLKFRTS-NH2 (SEQ ID NO: 3006) | --- | NA | --- | 11 | | | |
| | | --- | 18 | | | | | |
| JBT0057 | Ac-SGNTFVDERLLYFLTIGNMGMYAAQLKFRTS-Ttds-Lysin(biotin)-NH2 (SEQ ID NO: 3018) | --- | NA | --- | 15 | | | |
| | | --- | NA | | | | | |
| | | | 15 | | | | | |
| JBT0135 | Biotin-Ttds-LLYFLTIGNMGMYAAQLKFR-NH2 (SEQ ID NO: 3021) | --- | NA | --- | 10 (0.625µ) | | | |

FIG. 13B

| JBT-0049 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | | | | 0 | | M) | | | |
| JBT0136 | Biotin-Ttds-LYFLTIGNMGMYAAQLKFRT-NH2 (SEQ ID NO: 3014) | --- | | NA | --- | 11 (0.625μM) | | | |
| JBT0137 | Biotin-Ttds-YFLTIGNMGMYAAQLKFRTS-NH2 (SEQ ID NO: 3013) | --- | | 0 | --- | 2 | | | |
| JBT0138 | Biotin-Ttds-YFLTIGNMGMYAAQLKFR-NH2 (SEQ ID NO: 3012) | --- | | 0 | --- | 4 | | | |
| JBT0190 | Ac-KKSGNTFVDERLLYFLTIGNMGMYAAQLKFRTSKK-NH2 (SEQ ID NO: 3031) | --- | | 21 | 0.49 | 32 | 80 | 72 | |
| JBT0191* | Ac-MLGVLMRGISALTGDYTARFEFYLNKQTFN-NH2 (SEQ ID NO: 3054) | --- | | 27 | --- | 0 | 74 | | |
| JBT0192* | | | | 0 | | | | | |
| JBT0193 | Ac-KKSGNTFVDERLLYFLTIGNMGMYAAQLKFK-NH2 (SEQ ID NO: 3073) | 2.30 | 104.85 | 51 | 1.26 | 38 | 140 | 114 | |
| JBT0194 | Ac-KKSGNTFVDERLLYFLTIGNMGMYAAQKK-NH2 (SEQ ID NO: 3074) | --- | | 52 | --- | 8 | 149 | | |

FIG. 13C

| JBT-0049 | | Progress Curves of Inhibition of FXa | | | Extrinsic Tenase Inhibition by TFPI | | Factor IIa Generation | | | |
|---|---|---|---|---|---|---|---|---|---|---|
| PEPTIDE | SEQUENCE | $EC_{50}$ (μM) | % Inhibit (Max) | % Inhibit (2.5μM) | $EC_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0195 | Ac-KKSGNTFVDERLLYFLTIGNMGMYKK-NH2 (SEQ ID NO: 3075) | --- | | 0 | --- | 5 | | | |
| JBT0196 | Ac-KKSGNTFVDERLLYFLTIGNMKK-NH2 (SEQ ID NO: 3048) | --- | | 0 | --- | 12 | | | |
| JBT0197 | Ac-KKTFVDERLLYFLTIGNMGMYAAQLKFRTSKK-NH2 (SEQ ID NO: 3076) | 0.91 | 57.40 | 38 | 0.38 | 35 | 146 | | |
| JBT0198 | Ac-KKDERLLYFLTIGNMGMYAAQLKFRTSKK-NH2 (SEQ ID NO: 3077) | --- | | 39 | --- | 17 | | | |
| JBT0199 | Ac-KKLLYFLTIGNMGMYAAQLKFRTSKK-NH2 (SEQ ID NO: 3078) | --- | | 0 | --- | 20 | | | |
| JBT0200 | Ac-KKFLTIGNMGMYAAQLKFRTSKK-NH2 (SEQ ID NO: 3079) | --- | | 0 | --- | 17 | | | |
| JBT0201 | Ac-KKLLYFLTIGNMGMYAAQLKFRKK-NH2 (SEQ ID NO: 3080) | --- | | 0 | --- | 9 | | | |
| JBT0202 | Ac-KKLYFLTIGNMGMYAAQLKFRTKK-NH2 (SEQ ID NO: 3081) | --- | | 2 | --- | 23 | | | |
| JBT0203 | Ac-KKYFLTIGNMGMYAAQLKFRTSKK-NH2 (SEQ ID NO: 3082) | --- | | 0 | --- | 16 | | | |
| JBT0204 | Ac-KKSGNTFVDERLLYFLTIGNMGKK-NH2 (SEQ ID NO: 3060) | --- | | 0 | --- | 15 | | | |

FIG. 13D

| JBT-0049 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (µM) | % Inhibit (Max) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0243 | Ac-SGDTFVDERLLYFLTIGNMRMYAVQLKFRTS-NH2 (SEQ ID NO: 3085) | | | --- | 0 | | | |
| | | | 39 | --- | 37 | | | |
| JBT0244 | Ac-SGDTFVDERLLYFLTTGNMRMYAVQLKFRTS-NH2 (SEQ ID NO: 3086) | 0.51 | 41.53 | --- | 37 | | | |
| | | | 50 | | | | | |
| JBT0245 | Ac-SGDTFVDERLLYFLTIGDMRMYAVQLKFRTS-NH2 (SEQ ID NO: 3087) | --- | | --- | NA | | | |
| | | --- | 49 | --- | 21 | | | |
| | | 0.44 | 50.53 | --- | 24 | | | |
| | | | 45 | | | | | |
| | | | 44 | | | | | |
| JBT0344 | Ac-TFVDERLLYFLTIGNMGMYAAQLKF-NH2 (SEQ ID NO: 3038) | --- | 2 | --- | 1 | --- | | |
| JBT0345 | Ac-FVDERLLYFLTIGNMGMYAAQLKF-NH2 (SEQ ID NO: 3039) | --- | 2 | --- | 2 | --- | | |
| JBT0346 | Ac-VDERLLYFLTIGNMGMYAAQLKF-NH2 (SEQ ID NO: 3034) | --- | 0 | --- | 2 | --- | | |
| JBT0347 | Ac-TFVDERLLYFLTIGNMGMYAAQLK-NH2 (SEQ ID NO: 3040) | --- | 2 | --- | 4 | --- | | |
| JBT0348 | Ac-TFVDERLLYFLTIGNMGMYAAQ-NH2 (SEQ ID NO: 3084) | --- | 0 | --- | 2 | --- | | |

FIG. 14A

| JBT-0050 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0050 | Ac-SGRGCTKVIVFTFRHNKLIGYERRYNCTS-NH2 (SEQ ID NO: 3047) | --- | | NA | --- | NA | | 81 | 21 |
| | | --- | | NA | 0.14 | 25 | 32 | 38 | |
| | | --- | | NA | --- | NA | 46 | | |
| | | --- | | NA | --- | NA | 46 | | |
| | | 0.95 | 56.6 | 39 | 0.05 | 33 | 49 | | |
| | | --- | | NA | | | | | |
| | | 1.14 | 58.99 | 35 | | | | | |
| JBT0050 | Ac-SGRGCTKVIVFTFRHNKLIGYERRYNCTS-NH2 (SEQ ID NO: 3047) | --- | | 33 | --- | 28 | 23 | 36 | |
| JBT0054 | Biotin-Ttds-SGRGCTKVIVFTFRHNKLIGYERRYNCTS-Ttds-Lysin(biotin)-NH2 (SEQ ID NO: 3002) | 1.07 | 35.6 | 26 | 0.14 | 19 | 27 | | |
| | | --- | | NA | 0.16 | NA | | | |
| JBT0058 | Ac-SGRGCTKVIVFTFRHNKLIGYERRYNCTS-NH2 (SEQ ID NO: 3003) | 0.99 | 56.1 | 41 | 0.45 | 31 | | | |
| | | --- | | NA | --- | NA | | | |
| JBT0129 | Ac-SGRGCTKVIVFTFRHNKLIGYERRYNCTS-NH2; Cycl. C5-C27 (SEQ ID NO: 3026) | 1.07 | 60.9 | 42 | 0.37 | 28 | 27 | | |
| | | --- | | NA | 0.16 | 21 | | | |

FIG. 14B

| JBT-0050 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0130 | Biotin-Trds-SGRGCTKVIVFTFRHNKLIGYERRYNCTS-NH2; cycl. C6-C28 (SEQ ID NO: 3001) | -- | | 32 | 0.15 | 21 | 31 | 18 | |
| JBT0139 | Biotin-Trds-GRGCTKVIVFTFRHNKLIGY-NH2 (SEQ ID NO: 3008) | -- | | NA | -- | 9 | -- | -- | |
| | | | | 34 | | | | | |
| JBT0140 | Biotin-Trds-GCTKVIVFTFRHNKLIGYER-NH2 (SEQ ID NO: 3010) | -- | | 7 (0.625μM) | 0.10 | 15 | | | |
| JBT0141 | Biotin-Trds-CTKVIVFTFRHNKLIGYERR-NH2 (SEQ ID NO: 3009) | -- | | 0 | -- | 10 | 18 | 25 | |
| JBT0142 | Biotin-Trds-TKVIVFTFRHNKLIGYERRY-NH2 (SEQ ID NO: 3022) | -- | | 0 | 0.05 | NA | 34 | 55 | |
| JBT0143 | Biotin-Trds-KVIVFTFRHNKLIGYERRYN-NH2 (SEQ ID NO: 3023) | -- | | 0 | 0.04 | NA | 12 | -- | |
| | | | | 7 | 1.96 | 7 | | | |
| JBT0144 | Biotin-Trds-VIVFTFRHNKLIGYERRYNC-NH2 (SEQ ID NO: 3011) | -- | | 6 | 0.42 | 16 | 19 | -- | |
| | | | | NA | -- | 17 | -- | -- | |
| | | | | | | 18 | | | |

FIG. 14C

| JBT-0050 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0145 | Biotin-Ttds-VIVFTFRHNKLIGYER-NH2 (SEQ ID NO: 3024) | --- | | 0 | 0.03 | --- | --- | --- | |
| JBT0205 | Ac-KKSGRGCTKVIVFTFRHNKLIGYERRYNCTSK K-NH2 (SEQ ID NO: 3029) | --- | | 40 | --- | 34 | 134 | | |
| JBT0206* | Ac-TNYTGSEKCIRFVTRRYLGVRINCFHKGS-NH2 (SEQ ID NO: 3049) | 1.64 | 87.46 | 49 | 0.11 | 36 | --- | | |
| | | | | 0 | --- | 22 | | | |
| JBT0207* | Ac-TRNVVRRYECFGSTGCIKYFIHSRTGLNK-NH2 (SEQ ID NO: 3050) | --- | | | --- | 17 | | | |
| | | | | 9 | 0.22 | 20 | | | |
| JBT0208 | Ac-KKSGRGCTKVIVFTFRHNKLIGYERRYNKK-NH2 (SEQ ID NO: 3027) | --- | | | --- | 8 | --- | | |
| | | | | 7 | --- | 6 | | | |
| | | | | | | 18 | | | |
| JBT0209 | Ac-KKSGRGCTKVIVFTFRHNKLIGYERKK-NH2 (SEQ ID NO: 3051) | --- | | 0 | --- | 24 | | | |
| JBT0210 | Ac-KKSGRGCTKVIVFTFRHNKLIGKK-NH2 (SEQ ID NO: 3061) | --- | | 0 | --- | 17 | | | |
| | | | | | | 17 | | | |
| | | | | | | 13 | | | |
| JBT0211 | Ac- | --- | | 42 | --- | 31 | 182 | | |

FIG. 14D

| JBT-0050 | | Progress Curves of Inhibition of FXa | | Extrinsic Tenase Inhibition by TFPI | | Factor IIa Generation | | | |
|---|---|---|---|---|---|---|---|---|---|
| PEPTIDE | SEQUENCE | EC$_{50}$ (µM) | % Inhibit (Max) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM | |
| | KKGCTKVIVFTFRHNKLIGYERRYNCTSKK-NH2 (SEQ ID NO: 3032) | | | | | | | | |
| JBT0212 | Ac-KKKVIVFTFRHNKLIGYERRYNCTSKK-NH2 (SEQ ID NO: 3033) | --- | 48 | 0.04 | 35 | (250) | (650) | | |
| JBT0213 | Ac-KKVFTFRHNKLIGYERRYNCTSKK-NH2 (SEQ ID NO: 3083) | --- | 7 | --- | 23 | 49 | | | |
| JBT0214 | Ac-KKGRGCTKVIVFTFRHNKLIGYKK-NH2 (SEQ ID NO: 3052) | --- | 19 | 0.05 | 24 | | | | |
| JBT0215 | Ac-KKGCTKVIVFTFRHNKLIGYERKK-NH2 (SEQ ID NO: 3055) | --- | 0 | --- | 15 | | | | |
| JBT0216 | Ac-KKCTKVIVFTFRHNKLIGYERRKK-NH2 (SEQ ID NO: 3053) | --- | 0 | --- | 15 | | | | |
| JBT0217 | Ac-KKTKVIVFTFRHNKLIGYERRYKK-NH2 (SEQ ID NO: 3062) | --- | 1 | --- | 16 | | | | |
| | | --- | 6 | --- | 18 | | | | |
| JBT0218 | Ac-KKKVIVFTFRHNKLIGYERRYNKK-NH2 (SEQ ID NO: 3063) | --- | 1 | 1.06 | 18 | | | | |
| | | --- | 11 | | | | | | |
| | | --- | 4 | 1.18 | 12 | | | | |
| JBT0219 | Ac-KKVIVFTFRHNKLIGYERRYNCKK-NH2 (SEQ ID NO: 3030) | --- | 12 | | | | | | |
| | | --- | 8 | --- | 17 | 29 | | | |
| JBT0220 | Ac-KKIVFTFRHNKLIGYERRYNCTKK-NH2 (SEQ ID NO: 3064) | --- | 22 | 0.10 | 17 | | | | |
| | | --- | 0 | --- | 15 | | | | |

FIG. 14E

| JBT-0050 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0349 | Ac-GCTKVIVFTFRHNKLIGYERRYNCTS-NH2 (SEQ ID NO: 3041) | --- | | 19 | --- | 16 | | | |
| JBT0350 | Ac-CTKVIVFTFRHNKLIGYERRYNCTS-NH2 (SEQ ID NO: 3042) | 1.63 | 27.6 | 17 | --- | 28 | 54 | | |
| JBT0351 | Ac-TKVIVFTFRHNKLIGYERRYNCTS-NH2 (SEQ ID NO: 3043) | 1.65 | 33.8 | 21 | 0.18 | 13 | 55 | | |
| JBT0352 | Ac-GCTKVIVFTFRHNKLIGYERRYNCT-NH2 (SEQ ID NO: 3044) | no fit | | 18 | 0.27 | 26 | 30 | | |
| | | | | 1 | --- | 16 | | | |
| | | | | 0 | 0.21 | 19 | | | |
| | | 1.34 | 26.3 | 24 | --- | 8 | 65 | | |
| | | | | 19 | 0.35 | 24 | | | |
| JBT0353 | Ac-GCTKVIVFTFRHNKLIGYERRYNC-NH2 (SEQ ID NO: 3045) | --- | | 28 | --- | 18 | 76 | | |
| | | 0.72 | 24.5 | 21 | 0.61 | 30 | | | |
| | | | | | | 20 | | | |

FIG. 15A

| JBT-0101 | | Progress Curves of Inhibition of FXa | | | Extrinsic Tenase Inhibition by TFPI | | Factor IIa Generation | | | |
|---|---|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0052 | Biotin-Ttds-KKSGVWQTHPRYFWTMWPDIKGEVIVLFGTSKK-NH2 (SEQ ID NO: 3004) | --- | | NA | 0.22 | 20 | | | |
| | | --- | 57.24 | NA | 0.39 | 23 | | | |
| | | 1.47 | | 52 | --- | | | | |
| JBT0101 | Ac-KKSGVWQTHPRYFWTMWPDIKGEVIVLFGTSKK-NH2 (SEQ ID NO: 3036) | --- | | NA | 1.42 | 22 | 65 | 164 | 40 |
| | | | | | 0.24 | 21 | | | |
| | | 2.25 | 50.13 | 26 | --- | 20 | | | |
| JBT0101 | Ac-KKSGVWQTHPRYFWTMWPDIKGEVIVLFGTSKK-NH2 (SEQ ID NO: 3036) | 2.01 | 45.27 | 26 | 0.17 | 22 | 68 | 38 | |
| | | --- | | NA | --- | 19 | 60 | | |
| | | --- | | NA | | | | | |
| | | --- | | NA | | | | | |
| | | 1.51 | 44.8 | 31 | | | | | |
| JBT0101 | Ac-KKSGVWQTHPRYFWTMWPDIKGEVIVLFGTSKK-NH2 (SEQ ID NO: 3036) | --- | | 29 | --- | 19 | | | |

FIG. 15B

| JBT-0101 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| | | --- | | | | | | | |
| | | 1.94 | 37.47 | 18 | 0.25 | 14 | | | |
| JBT0103 | Ac-KKSGVWQTHPRYFWTMWPDIKGEVIVLFGTS-Ttds-KKLysin(biotin)-NH2 (SEQ ID NO: 3005) | --- | | 19 | 0.61 | 19 | | | |
| | | | | NA | 0.19 | 21 | | | |
| JBT0176* | Ac-KKVGSVTRWSMYGPIFIKFTWTLEQPVGWDH KK-NH2 (SEQ ID NO: 3056) | 1.69 | 38.91 | 24 | 0.17 | 17 | | | |
| | | --- | | 0 | --- | 17 | 150 | | |
| JBT0177* | Ac-KKLTGDWTYFWSKVIWGPGVIERQMPVSTFH KK-NH2 (SEQ ID NO: 3065) | --- | | 4 | --- | 16 | --- | | |
| | | | | | --- | 15 | | | |
| | | | | | --- | 10 | | | |
| | | | | | --- | 10 | | | |
| JBT0178 | Ac-KKSGVWQTHPRYFWTMWPDIKGEVIVLFGTK K-NH2 (SEQ ID NO: 3028) | | | 42 | 0.20 | 23 | 190 | 80 | |
| JBT0179 | Ac-KKSGVWQTHPRYFWTMWPDIKGEVIVLKK-NH2 (SEQ ID NO: 3066) | 1.51 | 65.93 | 42 | --- | 26 | 111 | | |
| | | --- | | 0 | --- | 14 | | | |
| JBT0180 | Ac-KKSGVWQTHPRYFWTMWPDIKGEVKK-NH2 (SEQ ID NO: 3067) | --- | | 0 | --- | 5 | | | |

FIG. 15C

| JBT-0101 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0181 | Ac-KKSGVWQTHPRYFWTMWPDIKKK-NH2 (SEQ ID NO: 3068) | --- | | 0 | --- | 2 | | | |
| JBT0182 | Ac-KKGVWQTHPRYFWTMWPDIKGEVIVLFGTSK-NH2 (SEQ ID NO: 3037) | --- | | 39 | 0.26 | 27 | 146 | | |
| JBT0183 | Ac-KKQTHPRYFWTMWPDIKGEVIVLFGTSKK-NH2 (SEQ ID NO: 3069) | 0.62 | 52.16 | 40 | --- | 19 | | | |
| JBT0184 | Ac-KKPRYFWTMWPDIKGEVIVLFGTSKK-NH2 (SEQ ID NO: 3070) | --- | | 0 | --- | 26 | | | |
| JBT0185 | Ac-KKFWTMWPDIKGEVIVLFGTSKK-NH2 (SEQ ID NO: 3057) | --- | | 0 | --- | 16 | | | |
| JBT0186 | Ac-KKSGVWQTHPRYFWTMWPDIKGKK-NH2 (SEQ ID NO: 3071) | --- | | 0 | --- | 14 | | | |
| JBT0187 | Ac-KKWQTHPRYFWTMWPDIKGEVIKK-NH2 (SEQ ID NO: 3072) | --- | | 0 | --- | 3 | | | |
| JBT0188 | Ac-KKHPRYFWTMWPDIKGEVIVLFKK-NH2 (SEQ ID NO: 3058) | --- | | 0 | --- | 5 | | | |
| JBT0189 | Ac-KKYFWTMWPDIKGEVIVLFGTSKK-NH2 (SEQ ID NO: 3059) | --- | | 0 | --- | 21 | | | |
| JBT0354 | Ac-KKGVWQTHPRYFWTMWPDIKGEVIVLFGTK | --- | | 26 | 0.62 | 14 | | | |

FIG. 15D

| JBT-0101 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| | K-NH2 (SEQ ID NO: 3088) | | | | | | | | |
| JBT0355 | Ac-KKVWQTHPRYFWTMWPDIKGEVIVLFGTKK-NH2 (SEQ ID NO: 3089) | 2.25 | 50.46 | 25 | 0.56 | 18 | | | |
| JBT0356 | Ac-KKWQTHPRYFWTMWPDIKGEVIVLFGTKK-NH2 (SEQ ID NO: 3090) | --- | | 12 | --- | 14 | | | |
| JBT0357 | Ac-KKGVWQTHPRYFWTMWPDIKGEVIVLFGKK-NH2 (SEQ ID NO: 3035) | --- | | 11 | no fit | 11 | | | |
| JBT0358 | Ac-KKGVWQTHPRYFWTMWPDIKGEVIVLFKK-NH2 (SEQ ID NO: 3046) | 2.51 | 55.65 | 30 | --- | 25 | | | |
| | | --- | | 26 | 0.58 | 20 | | | |
| | | 3.26 | 41.21 | 19 | --- | 27 | | | |
| | | | | 15 | 0.46 | 16 | | | |

FIG. 16A

| JBT-0120 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0120 | Ac-SGASRYKWF[CGMRDMKGTMSC]VWVKFRY DTS-NH2 (SEQ ID NO: 1047) | --- | | NA | 0.94 | 35 | 298 | 374 | 162 |
| | | 0.90 | 85.30 | 58 | 1.84 | 31 | | | |
| | | 1.50 | 88.65 | 48 | | | | | |
| JBT0120 | Ac-SGASRYKWF[CGMRDMKGTMSC]VWVKFRY DTS-NH2 (SEQ ID NO: 1047) | 1.50 | 74.75 | 43 | 0.86 | 45 | 355 | | |
| | | | | | | | 258 | | |
| | | 1.29 | 69.17 | 43 | 0.88 | 45 | | | |
| JBT0120 | Ac-SGASRYKWF[CGMRDMKGTMSC]VWVKFRY DTS-NH2 (SEQ ID NO: 1047) | 1.18 | 50.68 | 34 | 1.18 | 46 | 326 | 288 | |
| | | --- | | 37 | | 48 | 383 | | |
| | | --- | | 38 | | | 299 | | |
| | | 1.26 | 46.06 | 32 | 0.38 | 40 | | | |
| JBT0120 | Ac-SGASRYKWF[CGMRDMKGTMSC]VWVKFRY DTS-NH2*HCL (SEQ ID NO: 1047) | 2.64 | 93.62 | 43 | 0.98 | 43 | | | |
| JBT0124 | Biotin-Ttds-SGASRYKWFCGMRDMKGTMSCVWVKFRYD TS-NH2 (SEQ ID NO: 1290) | 1.59 | 73.59 | 41 | 1.26 | 36 | 273 | | |
| JBT0247 | Ac- | --- | | 43 | --- | 44 | | | |

FIG. 16B

| JBT-0120 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc:10µM | FVIII Deficient (mU/mL) Conc: 10µM | FIX Deficient (mU/mL) Conc: 10µM |
| | SGASRYKWFCGMRDMKGTMSCVWVKFRYDTS-NH2 (SEQ ID NO: 1213) | | | | | | | | |
| JBT0248 | Ac-KKSGASRYKWF[CGMRDMKGTMSC]VWVKFRYDTSKK-NH2 cyc. (SEQ ID NO: 1001) | 0.79 | 50.9 | 42 | 0.61 | 42 | | | |
| | | --- | | 54 | --- | 60 | 164 | | |
| JBT0249 | Ac-KKSGASRYKWFCGMRDMKGTMSKK-NH2 (SEQ ID NO: 1214) | 0.82 | 76.13 | 53 | 0.27 | 52 | | | |
| | | --- | | 0 | --- | 3 | inhib | | |
| | | | | | | 17 | | | |
| JBT0250 | Ac-KKSRYKWFCGMRDMKGTMSCVWKK-NH2 (SEQ ID NO: 1201) | --- | | 0 | 1.06 | 16 | inhib | | |
| | | | | | | 15 | | | |
| | | --- | | 11 | --- | 20 | inhib | | |
| | | | | | 0.61 | 19 | | | |
| JBT0251 | Ac-KKKWFCGMRDMKGTMSCVWVKFKK-NH2 (SEQ ID NO: 1202) | --- | | 17 | --- | 17 | inhib | | |
| | | 0.66 | 24.03 | 16 | 0.63 | 23 | | | |
| JBT0252 | Ac-KKCGMRDMKGTMSCVWVKFRYDKK-NH2 (SEQ ID NO: 1215) | --- | | 11 | --- | 18 | inhib | | |
| | | | | 13 | 1.02 | 18 | | | |
| | | 6.27 | 37.09 | 11 | | | | | |

FIG 16C

JBT-0120

| PEPTIDE | SEQUENCE | Progress Curves of Inhibition of FXa | | | Extrinsic Tenase Inhibition by TFPI | | Factor IIa Generation | | | |
|---|---|---|---|---|---|---|---|---|---|---|
| | | $EC_{50}$ ($\mu M$) | % Inhibit (Max) | % Inhibit (2.5$\mu M$) | $EC_{50}$ ($\mu M$) | % Inhibit (2.5$\mu M$) | Induced FVIII Deficiency FEIBA EA (mU/mL) Conc: 10$\mu M$ | FVIII Deficient (mU/mL) Conc: 10$\mu M$ | FIX Deficient (mU/mL) Conc: 10$\mu M$ |
| JBT0253 | Ac-KKMRDMKGTMSCVWVKFRYDTSKK-NH2 (SEQ ID NO: 1216) | --- | | 0 | --- | 15 | inhib | | |
| | | | | | --- | 23 | | | |
| | | | | | 0.55 | 23 | | | |
| JBT0319 | Ac-SGASRYKWFCGMRDMKGTMSCVWVKFRY-NH2, cyc (SEQ ID NO: 1002) | 0.51 | 71.07 | 59 | --- | 56 | 383 | 293 | |
| JBT0319 | Ac-SGASRYKWFCGMRDMKGTMSCVWVKFRY-NH2, cyc (SEQ ID NO: 1002) | 0.30 | 82.38 | 72 | --- | 60 | 466 | | |
| | | | | | | | 294 | | |
| JBT0320 | Ac-SGASRYKWF[CGMRDMKGTMSC]VWVK-NH2 (SEQ ID NO: 1103) | 18.80 | 73.34 | 9 | 6.40 | 7 | 153 | | |
| JBT0321 | Ac-SGASRYKWFCGMRDMKGTMSCV-NH2 (SEQ ID NO: 1217) | --- | | 0 | --- | 1 | --- | | |
| JBT0322 | Ac-SGASRYKWFCGMRDMKGTM-NH2 (SEQ ID NO: 1218) | --- | | 0 | --- | 5 | --- | | |
| JBT0322 | Ac-SGASRYKWFCGMRDMKGTM-NH2 (SEQ ID NO: 1218) | --- | | 0 | --- | 3 | --- | | |
| JBT0323 | Ac-SRYKWF[CGMRDMKGTMSC]VWVKFRYDTS-NH2 (SEQ ID NO: 1076) | 0.72 | 51.55 | 42 | 0.77 | 48 | 355 | 314 | |
| | | | | | | | 285 | | |
| JBT0324 | Ac-KWFCGMRDMKGTMSCVWVKFRYDTS- | --- | | 0 | 2.44 | 18 | 91 | | |

FIG 16D

| JBT-0120 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (µM) | % Inhibit (Max) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| | NH2 (SEQ ID NO: 1155) | | | | | | | |
| JBT0325 | Ac-[CGMRDMKGTMSC]VWVKFRYDTS-NH2 (SEQ ID NO: 1219) | -- | | -- | 4 | -- | | |
| JBT0326 | Ac-RDMKGTMSCVWVKFRYDTS-NH2 (SEQ ID NO: 1220) | -- | | -- | 3 | | | |
| JBT0326 | Ac-RDMKGTMSCVWVKFRYDTS-NH2 (SEQ ID NO: 1220) | -- | | -- | | -- | | |
| JBT0327 | Ac-SGASRYKWFCGMRDMKGTMS-NH2 (SEQ ID NO: 1222) | -- | 0 | -- | 0 | -- | | |
| JBT0328 | Ac-SRYKWFCGMRDMKGTMSCVW-NH2 (SEQ ID NO: 1223) | -- | 0 | -- | 1 | -- | | |
| JBT0329 | Ac-KWF[CGMRDMKGTMSC]VWVKF-NH2 (SEQ ID NO: 1156) | -- | 2 | -- | 8 | 70 | 66 | |
| | | -- | 4 | -- | 13 | 40 | | |
| | | no fit | 7 | 3.53 | 6 | 84 | | |
| JBT0330 | Ac-CGMRDMKGTMSCVWVKFRYD-NH2 (SEQ ID NO: 1224) | -- | 0 | -- | 9 | -- | | |
| JBT0330 | Ac-[CGMRDMKGTMSC]VWVKFRYD-NH2 (SEQ ID NO: 1224) | -- | 0 | -- | 7 | | | |
| JBT0331 | Ac-MRDMKGTMSCVWVKFRYDTS-NH2 (SEQ ID NO: 1225) | -- | 0 | -- | 5 | -- | | |
| JBT0331 | Ac-MRDMKGTMSCVWVKFRYDTS-NH2 (SEQ ID NO: 1225) | -- | 0 | -- | 5 | -- | | |
| JBT0332 | Ac-SRYKWFCGMRDMKGTMSCVW-NH2 (SEQ ID NO: 1206) | -- | 1 | -- | 5 | -- | | |

FIG 16E

| JBT-0120 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0333 | Ac-KWFCGMRDMKGTMSCVWVKF-NH2 (SEQ ID NO: 1207) | --- | | 3 | --- | 12 | 40 | --- | |
| JBT0333 | Ac-KWFCGMRDMKGTMSCVWVKF-NH2 (SEQ ID NO: 1207) | --- | | 4 | --- | 11 | 114 | | |
| JBT0334 | Ac-CGMRDMKGTMSCVWVKFRYD-NH2 (SEQ ID NO: 1227) | --- | | 0 | --- | 3 | --- | | |
| JBT0409 | Ac-SGASRYKWFSGMRDMKGTMSSVWVKFRYDTS-NH2 (SEQ ID NO: 1204) | --- | | 0 | --- | 5 | inhib | | |
| JBT0410 | Ac-SGASRYKWFSG-Nle-RD-Nle-KGT-Nle-SSVWVKFRYDTS-NH2 (SEQ ID NO: 1208) | --- | | 0 | --- | 7 | inhib | | |
| JBT0411 | Ac-SGASRYKWF[CG-Nle-RD-Nle-KGT-Nle-SC]VWVKFRYDTS-NH2 (SEQ ID NO: 1104) | --- | | 11 | --- | 24 | 97 | | |
| JBT0412 | Ac-KWF[CG-Nle-RD-Nle-KGT-Nle-SC]VWVKF-NH2 (SEQ ID NO: 1) | --- | | 7 | --- | 12 | 46 | | |
| JBT0413 | Ac-KWFSGMRDMKGTMSSVWVKF-NH2 (SEQ ID NO: 1228) | --- | | 0 | --- | 2 | inhib | | |
| JBT0414 | Ac-KWFSG-Nle-RD-Nle-KGT-Nle-SSVWVKF-NH2 (SEQ ID NO: 1205) | --- | | 4 | --- | 8 | inhib | | |
| JBT0415 | Ac-SRYKWF[CGMRDMKGTMSC]VWVKF-NH2 (SEQ ID NO: 1003) | --- | | 59 | 0.19 | 43 | 359 | | |
| | | | | 66 | | | | | |
| | | 0.38 | 74.56 | 61 | | 52 | | | |

FIG 16F

| JBT-0120 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | $EC_{50}$ (µM) | % Inhibit (Max) | % Inhibit (2.5µM) | $EC_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0416 | Ac-SRYKWF[CG-Nle-RD-Nle-KGT-Nle-SC]VWVKF-NH2 (SEQ ID NO: 1077) | --- | | 52 | --- | 46 | 256 | | |
| JBT0417 | Ac-SRYKWFSGMRDMKGTMSSVWVKF-NH2 (SEQ ID NO: 1229) | --- | | 2 | --- | 11 | inhib | | |
| JBT0418 | Ac-SRYKWFSG-Nle-RD-Nle-KGT-Nle-SSVWVKF-NH2 (SEQ ID NO: 1210) | no fit | | 0 | no fit | 6 | | | |
| | | --- | | 4 | --- | 11 | inhib | | |
| JBT0435* | Ac-RKRDVSGKM[CWSGFGSKWFRC]ADMMTYYSVT-NH2 (SEQ ID NO: 1211) | --- | | 0 | --- | 5 | | | |
| JBT0436* | Ac-RWSGKSTYS[CDAMVRRMGMKC]FSFGWTDVYK-NH2 (SEQ ID NO: 1212) | --- | | 0 | --- | 0 | | | |

FIG. 17A

| JBT-0121 PEPTIDE | SEQUENCE | Progress Curves of Inhibition of FXa | | | Extrinsic Tenase Inhibition by TFPI | | Factor IIa Generation | | |
|---|---|---|---|---|---|---|---|---|---|
| | | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0121 | Ac-SGGRKHKHFLRSNGKPSRALCSMHFWRWSTS-NH2 (SEQ ID NO: 3091) | --- | | NA | --- | 15 | 22 | 37 | 25 |
| | | 0.08 | 14.44 | 14 | 0.17 | 11 | inhib | | |
| | | --- | | 8 | --- | 19 | | | |
| JBT0125 | Biotin-Ttds-SGGRKHLHFLRSNGKPSRALCSMHFWRWSTS-NH2 (SEQ ID NO: 3092) | 0.10 | 17.22 | 15 | 0.45 | 9 | | | |
| JBT0419 | Ac-SGGRKHKHFLRSNGKPSRALSSMHFWRWSTS-NH2 (SEQ ID NO: 3093) | --- | | 6 | --- | 7 | | | |
| JBT0420* | Ac-KGSSRSGHNALKTHSWMSPFRRGSWSLHFK-NH2 (SEQ ID NO: 3094) | --- | | 3 | --- | 10 | inhib | | |
| JBT0421* | Ac-KSRSGFWHAWSHRTRPMKSRLHLGKFSNSSG-NH2 (SEQ ID NO: 3095) | --- | | 3 | --- | 5 | | | |
| JBT0422 | Ac-SGGRKHKHFLRSNGKPSRALSSMHFWRW-NH2 (SEQ ID NO: 3096) | --- | | 4 | --- | 11 | inhib | | |
| JBT0423 | Ac-SGGRKHKHFLRSNGKPSRALSSMHF-NH2 (SEQ ID NO: 3097) | --- | | 2 | --- | 1 | inhib | | |
| JBT0424 | Ac-SGGRKHKHFLRSNGKPSRALSS-NH2 (SEQ | --- | | 1 | --- | 0 | --- | | |

FIG. 17B

| JBT-0121 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| | Ac-SGGRKHKHFLRSNGKPSRA-NH2 (SEQ ID NO: 3098) | | | | | | | | |
| JBT0425 | Ac-SGGRKHKHFLRSNGKPSRA-NH2 (SEQ ID NO: 3099) | --- | | 3 | --- | 0 | | | |
| JBT0426 | Ac-RKHKHFLRSNGKPSRALSSMHFWRWSTS-NH2 (SEQ ID NO: 3100) | --- | | 2 | --- | 8 | inhib | | |
| JBT0427 | Ac-KHFLRSNGKPSRALSSMHFWRWSTS-NH2 (SEQ ID NO: 3101) | --- | | 0 | --- | 0 | | | |
| JBT0428 | Ac-LRSNGKPSRALSSMHFWRWSTS-NH2 (SEQ ID NO: 3102) | --- | | 2 | --- | 1 | --- | | |
| JBT0429 | Ac-NGKPSRALSSMHFWRWSTS-NH2 (SEQ ID NO: 3103) | --- | | 0 | --- | 0 | | | |
| JBT0430 | Ac-SGGRKHKHFLRSNGKPSRAL-NH2 (SEQ ID NO: 3104) | --- | | 0 | --- | 0 | | | |
| JBT0431 | Ac-RKHKHFLRSNGKPSRALSSM-NH2 (SEQ ID NO: 3105) | --- | | 2 | --- | 8 | --- | | |
| JBT0432 | Ac-KHFLRSNGKPSRALSSMHFW-NH2 (SEQ ID NO: 3106) | --- | | 3 | --- | 1 | | | |
| JBT0433 | Ac-LRSNGKPSRALSSMHFWRWS-NH2 (SEQ ID NO: 3107) | --- | | 0 | --- | 1 | --- | | |
| JBT0434 | Ac-SNGKPSRALSSMHFWRWSTS-NH2 (SEQ ID NO: 3108) | --- | | 0 | --- | 0 | | | |

FIG. 18A

| JBT-0122 | | Progress Curves of Inhibition of FXa | | | Extrinsic Tenase Inhibition by TFPI | | Factor IIa Generation | | |
|---|---|---|---|---|---|---|---|---|---|
| PEPTIDE | SEQUENCE | EC$_{50}$ (μM) | % Inhibit (Max) | % Inhibit (2.5μM) | EC$_{50}$ (μM) | % Inhibit (2.5μM) | Induced FVIII Deficiency FEIBA EA (mU/mL) Conc: 10μM | FVIII Deficient (mU/mL) Conc: 10μM | FIX Deficient (mU/mL) Conc: 10μM |
| JBT0122 | Ac-SGYASFPLAVQLHVSKRSKEMALARLYYKTS-NH2 (SEQ ID NO: 2002) | --- | | NA | 12.7 | 5 | 115 | 139 | 60 |
| | | 15.5 | 93.8 | 15 | 39.5 | 8 | 175 | 160 | |
| | | 7.92 | 78.52 | 23 | --- | 9 | 183 | | |
| | | --- | | 9 | | | 210 | | |
| | | --- | | 11 | | | | | |
| JBT0122 | Ac-SGYASFPLAVQLHVSKRSKEMALARLYYKTS-NH2*HCL (SEQ ID NO: 2002) | 15.81 | 64.12 | 6 | 6.70 | 7 | | | |
| JBT0126 | Biotin-Ttds-SGYASFPLAVQLHVSKRSKEMALARLYYKTS-NH2 (SEQ ID NO: 2498) | --- | | NA | 5.05 | 5 | | | |
| JBT0221 | Ac-KKSGYASFPLAVQLHVSKRSKEMALARLYYKTSKK-NH2 (SEQ ID NO: 2003) | 14.1 | 88.4 | 17 | 3.37 | 19 | 218 | | |
| | | --- | | 10 | | | | | |
| | | | | 29 | | | | | |
| JBT0222* | Ac-MKSRSLGLAYFAKHSSLEVLQTRKVAAPYY-NH2 (SEQ ID NO: 2127) | --- | | 0 | --- | 4 | --- | | |

FIG. 18B

| JBT-0122 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC₅₀ (µM) | % Inhibit (Max) | % Inhibit (2.5µM) | EC₅₀ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0223* | Ac-KMQLRVYASTAHSRYLLGSSLFPKYAEVKA-NH2 (SEQ ID NO: 2297) | --- | | 0 | --- | 5 | | | |
| | | | | | --- | 4 | --- | | |
| | | | | | | 1 | | | |
| JBT0224 | Ac-KKSGYASFPLAVQLHVSKRSKEMALARLYYK-NH2 (SEQ ID NO: 2298) | --- | | 14 | 3.49 | 3 | 191 | | |
| JBT0225 | Ac-KKSGYASFPLAVQLHVSKRSKEMALARKK-NH2 (SEQ ID NO: 2128) | --- | | 26 | --- | 18 | 203 | 162 | |
| JBT0226 | Ac-KKSGYASFPLAVQLHVSKRSKEMAKK-NH2 (SEQ ID NO: 2299) | --- | | 9 | --- | 0 | 55 | | |
| | | | | 12 | | | | | |
| JBT0227 | Ac-KKSGYASFPLAVQLHVSKRSKKK-NH2 (SEQ ID NO: 2300) | --- | | 4 | --- | 0 | | | |
| | | | | 6 | | | | | |
| JBT0228 | Ac-KKASFPLAVQLHVSKRSKEMALARLYYKTSK-NH2 (SEQ ID NO: 2016) | --- | | 0 | --- | 5 | | | |
| | | | | 4 | 6.93 | 9 | | | |

FIG. 18C

JBT-0122

| PEPTIDE | SEQUENCE | Progress Curves of Inhibition of FXa | | | Extrinsic Tenase Inhibition by TFPI | | Factor IIa Generation | | |
|---|---|---|---|---|---|---|---|---|---|
| | | EC₅₀ (µM) | % Inhibit (Max) | % Inhibit (2.5µM) | EC₅₀ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0229 | Ac-KKPLAVQLHVSKRSKEMALARLYYKTSKK-NH2 (SEQ ID NO: 2129) | --- | | 21 | | 0 | | | |
| JBT0230 | Ac-KKVQLHVSKRSKEMALARLYYKTSKK-NH2 (SEQ ID NO: 2301) | --- | | 0 | --- | 0 | | | |
| JBT0231 | Ac-KKHVSKRSKEMALARLYYKTSKK-NH2 (SEQ ID NO: 2302) | --- | | 0 | --- | 0 | | | |
| JBT0232 | Ac-KKGYASFPLAVQLHVSKRSKEMKK-NH2 (SEQ ID NO: 2303) | --- | | 4 | --- | 2 | | | |
| JBT0233 | Ac-KKYASFPLAVQLHVSKRSKEMAKK-NH2 (SEQ ID NO: 2304) | 13.25 | 38.12 | 6 | --- | 6 | | | |
| JBT0234 | Ac-KKVQLHVSKRSKEMALARLYKKK-NH2 (SEQ ID NO: 2305) | --- | | 8 0 | --- | 3 | | | |
| JBT0235 | Ac-KKQLHVSKRSKEMALARLYYKTKK-NH2 (SEQ ID NO: 2306) | --- | | 0 | --- | 0 | | | |
| JBT0236 | Ac-KKLHVSKRSKEMALARLYYKTSKK-NH2 (SEQ ID NO: 2307) | --- | | 0 | --- | 0 | | | |

FIG. 18D

| JBT-0122 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| JBT0237 | Ac-KKSGYASFPLAVQLHVSKRSKEKK-NH2 (SEQ ID NO: 2308) | --- | | 0 | --- | 2 | | | |
| JBT0359 | Ac-ASFPLAVQLHVSKRSKEMA-NH2 (SEQ ID NO: 2309) | --- | | 0 | --- | 6 | --- | | |
| JBT0360 | Ac-SFPLAVQLHVSKRSKEMA-NH2 (SEQ ID NO: 2310) | --- | | 1 | --- | 2 | --- | | |
| JBT0361 | Ac-FPLAVQLHVSKRSKEMA-NH2 (SEQ ID NO: 2311) | --- | | 0 | --- | 9 | --- | | |
| JBT0362 | Ac-ASFPLAVQLHVSKRSKEM-NH2 (SEQ ID NO: 2312) | --- | | 0 | --- | 6 | --- | | |
| JBT0363 | Ac-ASFPLAVQLHVSKRSKE-NH2 (SEQ ID NO: 2313) | --- | | 0 | --- | 9 | --- | | |
| JBT0364 | Ac-ASFPLAVQLHVSKRSKEMAL-NH2 (SEQ ID NO: 2314) | --- | | 2 | --- | 12 | --- | | |
| JBT0365 | Ac-ASFPLAVQLHVSKRSKEMALA-NH2 (SEQ ID NO: 2315) | --- | | 0 | --- | 9 | --- | | |
| JBT0366 | Ac-ASFPLAVQLHVSKRSKEMALAR-NH2 (SEQ ID NO: 2316) | --- | | 0 | --- | 11 | --- | | |
| JBT0367 | Ac-ASFPLAVQLHVSKRSKEMALARL-NH2 (SEQ ID NO: 2317) | --- | | 2 | --- | 10 | 28 | | |
| JBT0368 | Ac-ASFPLAVQLHVSKRSKEMALARLY-NH2 (SEQ ID NO: 2130) | --- | | 0 | --- | 8 | 36 | | |
| JBT0369 | Ac-ASFPLAVQLHVSKRSKEMALARLYY-NH2 | --- | | 2 | --- | 9 | 68 | | |

FIG. 18E

| JBT-0122 | | Progress Curves of Inhibition of FXa | | Extrinsic Tenase Inhibition by TFPI | | Factor IIa Generation | | |
|---|---|---|---|---|---|---|---|---|
| PEPTIDE | SEQUENCE | EC$_{50}$ (µM) | % Inhibit (Max) | % Inhibit (2.5µM) | EC$_{50}$ (µM) | % Inhibit (2.5µM) | Induced FVIII Deficiency FEIBA EA (mU/mL) Conc: 10µM | FVIII Deficient (mU/mL) Conc: 10µM | FIX Deficient (mU/mL) Conc: 10µM |
| | (SEQ ID NO: 2017) | | | | | | | | |
| JBT0370 | Ac-YASFPLAVQLHVSKRSKEMA-NH2 (SEQ ID NO: 2318) | -- | | 2 | -- | 0 | 39 | | |
| JBT0371 | Ac-GYASFPLAVQLHVSKRSKEMA-NH2 (SEQ ID NO: 2319) | -- | | 8 | -- | 1 | 60 | | |

FIG. 19A

| JBT0047 class | | BiaCore | | |
|---|---|---|---|---|
| Peptide | Sequence | $k_{on}$ (1/Ms) | $k_{off}$ (1/s) | $K_D$ (M) |
| JBT0047 | Ac-SGVGRLQVAFQSKKNVFVFGYFERLRAKLTS-NH2 (SEQ ID NO: 253) | 3.98E+05 | 1.88E-02 | 4.72E-08 |
| JBT0131 | Biotin-Tds-AFQSKKNVFVFGYFERLRAK-NH2 (SEQ ID NO: 964) | 1.38E+05 | 5.94E-02 | 4.31E-07 |
| JBT0132 | Biotin-Tds-FQSKKNVFVFGYFERLRAKL-NH2 (SEQ ID NO: 965) | 3.55E+04 | 3.26E-02 | 9.17E-07 |
| JBT0155 | Ac-KKSGVGRLQVAFQSKKNVFVFGYFERLRAKLTSKK-NH2 (SEQ ID NO: 8) | 1.64E+05 | 7.25E-03 | 4.41E-08 |
| JBT0158 | Ac-KKSGVGRLQVAFQSKKNVFVFGYFERLRAKKK-NH2 (SEQ ID NO: 9) | 4.49E+05 | 3.27E-02 | 7.29E-08 |
| JBT0164 | Ac-KKFQSKKNVFVFGYFERLRAKLTSKK-NH2 (SEQ ID NO: 12) | 2.26E+05 | 1.05E-02 | 4.65E-08 |
| JBT0170 | Ac-KKFQSKKNVFVFGYFERLRAKLKK-NH2 (SEQ ID NO: 13) | 4.09E+05 | 9.34E-03 | 2.28E-08 |
| JBT0175 | Ac-KKAFQSKKNVFVFGYFERLRAKLTKK-NH2 (SEQ ID NO: 182) | 2.70E+05 | 1.67E-02 | 6.18E-08 |
| JBT0293 | Ac-FQSKKNVFVFGYFERLRAKL-NH2 (SEQ ID NO: 256) | 2.17E+05 | 2.12E-02 | 9.74E-08 |
| JBT0294 | Ac-YQSKKNVFVFGYFERLRAKL-NH2 (SEQ ID NO: 257) | 5.69E+05 | 3.92E-02 | 6.90E-08 |
| JBT0297 | Ac-FQSKNNVFVFGYFERLRAKL-NH2 (SEQ ID NO: 183) | 5.69E+05 | 3.92E-02 | 6.90E-08 |
| JBT0302 | Ac-FQSKKNVFVAGYFERLRAKL-NH2 (SEQ ID NO: 258) | 1.02E+06 | 8.47E-02 | 8.27E-08 |
| JBT0303 | Ac-FQSKKNVFVDGYFERLRAKL-NH2 (SEQ ID NO: 184) | 8.13E+05 | 2.75E-02 | 3.38E-08 |
| JBT0305 | Ac-FQSKKNVFVQGYFERLRAKL-NH2 (SEQ ID NO: 260) | 7.45E+05 | 3.07E-02 | 4.11E-08 |
| JBT0306 | Ac-FQSKKNVFVSGYFERLRAKL-NH2 (SEQ ID NO: 185) | 6.56E+05 | 3.61E-02 | 5.50E-08 |
| JBT0307 | Ac-FQSKKNVFVYGYFERLRAKL-NH2 (SEQ ID NO: 261) | 5.95E+05 | 3.15E-02 | 5.30E-08 |
| JBT0310 | Ac-FQSKKNVFVFGYFDRLRAKL-NH2 (SEQ ID NO: 262) | 5.62E+04 | 1.05E-02 | 1.87E-07 |
| JBT0337 | Ac-FQSKNNVFVFGYFDRLRAKL-NH2 (SEQ ID NO: 16) | 2.90E+05 | 5.30E-03 | 1.83E-08 |
| JBT0342 | Ac-FQSKNNVFVFGYFDRLRAKL-NH2 (SEQ ID NO: 19) | 3.92E+05 | 6.55E-03 | 1.67E-08 |
| JBT0343 | Ac-FQSKKNVFVFGYFDRLRAKL-NH2 (SEQ ID NO: 188) | 3.28E+05 | 1.46E-02 | 4.46E-08 |
| JBT0375 | Ac-FQSKGNVFVFGYFERLRAKL-NH2 (SEQ ID NO: 190) | 4.00E+05 | 1.21E-02 | 3.04E-08 |
| JBT0471 | Ac-FQSKGNVFVTGYFKGYFERLRAKL-NH2 (SEQ ID NO: 26) | 7.03E+05 | 9.34E-03 | 1.33E-08 |
| JBT0474 | Ac-FQSKGNVFVKGYFERLRAKL-NH2 (SEQ ID NO: 29) | 9.95E+05 | 1.49E-02 | 1.50E-08 |
| JBT0477 | Ac-FQSKGNVFVDGYFERLRAKL-NH2 (SEQ ID NO: 32) | 3.72E+05 | 3.02E-03 | 8.10E-09 |
| JBT0500 | Ac-FQSK-NmetGly-NVFVFGYFERLRAKL-NH2 (SEQ ID NO: 46) | 2.52E+05 | 2.06E-03 | 8.19E-09 |
| JBT0683 | Ac-FQSK-Nmg-AVFVDGYFARLRAKL-NH2 (SEQ ID NO: 55) | 1.00E+06 | 1.07E-03 | 1.07E-09 |

FIG. 19B

| JBT0047 class | | BiaCore | | |
| --- | --- | --- | --- | --- |
| Peptide | Sequence | $k_{on}$ (1/Ms) | $k_{off}$ (1/s) | $K_D$ (M) |
| JBT0765 | Ac-FQSKGNVFVDGYFERL-Few-AKL-NH2 (SEQ ID NO: 68) | 2.31E+05 | 1.85E-03 | 8.00E-09 |
| JBT0789 | Ac-FQSK-Nmg-NVFVDGYFERL-Nle-AKL-NH2 (SEQ ID NO: 71) | 1.92E+05 | 4.06E-04 | 2.12E-09 |
| JBT1122 | Ac-FQSK-Nmg-NVFVDGYFARL-Nle-AKL-NH2 (SEQ ID NO: 113) | 6.99E+04 | 9.61E-04 | 1.38E-08 |
| JBT1141 | Ac-FQSKkAVFVKGYFARLRAKL-NH2 (SEQ ID NO: 120) | 1.36E+05 | 3.16E-03 | 2.33E-08 |
| JBT1144 | Ac-FQSKdAVFVKGYFARLRAKL-NH2 (SEQ ID NO: 121) | 3.05E+05 | 1.00E-02 | 3.28E-08 |

FIGURE 20

| JBT0120 class | | BiaCore | | |
| --- | --- | --- | --- | --- |
| Peptide | Sequence | $k_{on}$ (1/Ms) | $k_{off}$ (1/s) | $K_D$ (M) |
| JBT0120 | Ac-SGASRYKWF[CGMRDMKGTMSC]VWVKFRYDTS-NH2 (SEQ ID NO: 1047) | 1.17E+06 | 4.78E-02 | 4.08E-08 |
| JBT0320 | Ac-SGASRYKWF[CGMRDMKGTMSC]VWVK-NH2 (SEQ ID NO: 1103) | 1.78E+05 | 4.25E-02 | 2.38E-07 |
| JBT0324 | Ac-KWFCGMRDMKGTMSCVWVKFRYDTS-NH2 (SEQ ID NO: 1155) | 1.54E+04 | 6.36E-03 | 4.14E-07 |
| JBT0415 | Ac-SRYKWF[CGMRDMKGTMSC]VWVKF-NH2 (SEQ ID NO: 1003) | 1.75E+05 | 2.24E-02 | 1.28E-07 |
| JBT0444 | Ac-SRYKWF[CAMRDMKGTMSC]VWVKF-NH2 (SEQ ID NO: 1004) | 4.18E+05 | 1.21E-02 | 2.90E-08 |
| JBT0447 | Ac-SRYKWF[CGMRAMKGTMSC]VWVKF-NH2 (SEQ ID NO: 1158) | 6.86E+03 | 5.60E-03 | 8.16E-07 |
| JBT0455 | Ac-SRYKWF[CGMRDMKGTMSC]AWVKF-NH2 (SEQ ID NO: 1049) | 4.77E+05 | 3.03E-02 | 6.35E-08 |
| JBT0643 | Ac-SRYKWF[CGMPDMKGTMSC]VWVKF-NH2 (SEQ ID NO: 1006) | 1.78E+05 | 3.22E-02 | 1.81E-07 |

FIGURE 21

| JBT0122 class | | BiaCore | | |
|---|---|---|---|---|
| Peptide | Sequence | $k_{on}$ (1/Ms) | $k_{off}$ (1/s) | $K_D$ (M) |
| JBT0122 | AC-SGYASFPLAVQLHVSKRSKEMALARLYYKTS-NH2 (SEQ ID NO: 2002) | 1.13E+04 | 2.23E-02 | 1.97E-06 |
| JBT0221 | Ac-KKSGYASFPLAVQLHVSKRSKEMALARLYYKTSKK-NH2 (SEQ ID NO: 2003) | 6.31E+04 | 1.19E-02 | 1.88E-07 |
| JBT0224 | Ac-KKSGYASFPLAVQLHVSKRSKEMALARLYYKK-NH2 (SEQ ID NO: 2298) | 6.39E+04 | 1.95E-02 | 3.05E-07 |

FIG. 22A

| JBT0047 class | | FXa Inhibition assay | | | | |
|---|---|---|---|---|---|---|
| Peptide | Sequence | EC50 (µM) | Maximal inhibition (%) | % Inhibition @ 2.5µM | % Inhibition @ 0.63µM |
| JBT0047 | Ac-SGVGRLQVAFQSKKNVFGYFERLRAKLTS-NH2 (SEQ ID NO: 253) | 0.72 | | 68 | |
| JBT0051 | Biotin-Ttds-SGVGRLQVAFQSKKNVFGYFERLRAKLTS-NH2 (SEQ ID NO: 962) | 0.53 | | 66 | |
| JBT0055 | Ac-SGVGRLQVAFQSKKNVFGYFERLRAKLTS-Ttds-Lysin(biotin)-NH2 (SEQ ID NO: 963) | 0.53 | | 72 | |
| JBT0131 | Biotin-Ttds-AFQSKKNVFGYFERLRAK-NH2 (SEQ ID NO: 964) | 8.20 | | 23 | |
| JBT0132 | Biotin-Ttds-FQSKKNVFGYFERLRAKL-NH2 (SEQ ID NO: 965) | 1.15 | | 36 | |
| JBT0133 | Biotin-Ttds-QSKKNVFGYFERLRAKLT-NH2 (SEQ ID NO: 966) | | | 15 | |
| JBT0134 | Biotin-Ttds-QSKKNVFGYFERLRAK-NH2 (SEQ ID NO: 967) | | | 5 | |
| JBT0155 | Ac-KKSGVGRLQVAFQSKKNVFGYFERLRAKLTSKK-NH2 (SEQ ID NO: 8) | 0.97 | | 54 | |
| JBT0156* | Ac-VVEKLTFVQLSFLNRRRFSQYAGFKGAGKV-NH2 (SEQ ID NO: 742) | | | 0 | |
| JBT0157* | Ac-RVFLYFSGKAGGLVKLVERQAFQTNVSKFR-NH2 (SEQ ID NO: 743) | | | 0 | |
| JBT0158 | Ac-KKSGVGRLQVAFQSKKNVFGYFERLRAKKK-NH2 (SEQ ID NO: 9) | 4.26 | | 35 | |
| JBT0159 | Ac-KKSGVGRLQVAFQSKKNVFGYFERLRLKK-NH2 (SEQ ID NO: 744) | | | 0 | |
| JBT0160 | Ac-KKSGVGRLQVAFQSKKNVFGYFGYFKK-NH2 (SEQ ID NO: 745) | | | 0 | |
| JBT0161 | Ac-KKSGVGRLQVAFQSKKNVFVFKK-NH2 (SEQ ID NO: 746) | | | 0 | |
| JBT0162 | Ac-KKKGRLQVAFQSKKNVFGYFERLRAKLTSKK-NH2 (SEQ ID NO: 10) | 0.74 | | 54 | |
| JBT0163 | Ac-KKQVAFQSKKNVFGYFERLRAKLTSKK-NH2 (SEQ ID NO: 11) | 1.54 | | 48 | |
| JBT0164 | Ac-KKFQSKKNVFGYFERLRAKLTSKK-NH2 (SEQ ID NO: 12) | 1.74 | | 43 | |
| JBT0165 | Ac-KKKKNVFGYFERLRAKLTSKK-NH2 (SEQ ID NO: 712) | | | 0 | |
| JBT0166 | Biotinyl-Ttds-KKFQSKKNVFGYFERLRAKLKK-NH2 (SEQ ID NO: 968) | 2.60 | | 50 | |
| JBT0167* | Biotinyl-Ttds-GKNAKFYLFESLRQVKFVFR-NH2 (SEQ ID NO: 969) | | | 0 | |
| JBT0168* | Biotinyl-Ttds-YKFSFNKELFKQARLRFVGV-NH2 (SEQ ID NO: 970) | | | 0 | |

FIG. 22B

| JBT0047 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0169 | Ac-KKAFQSKKNVFVFGYFERLRAKKK-NH2 (SEQ ID NO: 254) | | | 16 | |
| JBT0170 | Ac-KKFQSKKNVFVFGYFERLRAKLKK-NH2 (SEQ ID NO: 13) | | | 61 | |
| JBT0171 | Ac-KKQSKKNVFVFGYFERLRAKLTKK -NH2 (SEQ ID NO: 255) | | | 25 | |
| JBT0172 | Ac-KKQSKKNVFVFGYFERLRAKKK-NH2 (SEQ ID NO: 406) | | | 7 | |
| JBT0173 | Biotinyl-Ttds-SGVGRLQVAFQSKKNVFVFG-NH2 (SEQ ID NO: 971) | | | 0 | |
| JBT0174 | Ac-KKAFQSKKNVFVFGYFERLRAKLKK-NH2 (SEQ ID NO: 14) | | | 47 | |
| JBT0175 | Ac-KKAFQSKKNVFVFGYFERLRAKLTKK-NH2 (SEQ ID NO: 182) | 2.71 | | 40 | |
| JBT0293 | Ac-FQSKKNVFVFGYFERLRAKL-NH2 (SEQ ID NO: 256) | 3.11 | 61 | 26 | 8 |
| JBT0294 | Ac-YQSKKNVFVFGYFERLRAKL-NH2 (SEQ ID NO: 257) | 4.07 | | 40 | |
| JBT0295 | Ac-FSSKKNVFVFGYFERLRAKL-NH2 (SEQ ID NO: 713) | | | 2 | |
| JBT0296 | Ac-FQNKKNVFVFGYFERLRAKL-NH2 (SEQ ID NO: 407) | 4.91 | | 19 | |
| JBT0297 | Ac-FQSKNNVFVFGYFERLRAKL-NH2 (SEQ ID NO: 183) | 0.63 | | 59 | |
| JBT0298 | Ac-FQSKQNVFVFGYFERLRAKL-NH2 (SEQ ID NO: 747) | 1.83 | | 42 | |
| JBT0299 | Ac-FQSKKNVFAFGYFERLRAKL-NH2 (SEQ ID NO: 408) | 15.31 | | 9 | |
| JBT0300 | Ac-FQSKKNVFSFGYFERLRAKL-NH2 (SEQ ID NO: 409) | | | 7 | |
| JBT0301 | Ac-FQSKKNVFTFGYFERLRAKL-NH2 (SEQ ID NO: 410) | | | 9 | |
| JBT0302 | Ac-FQSKKNVFVFGYFAGYFERLRAKL-NH2 (SEQ ID NO: 258) | 2.10 | | 47 | |
| JBT0303 | Ac-FQSKKKNVFVFGYFDGYFERLRAKL-NH2 (SEQ ID NO: 184) | 0.88 | 69 | 50 | 26 |
| JBT0304 | Ac-FQSKKNVFVFGYFLGYFERLRAKL-NH2 (SEQ ID NO: 259) | 2.95 | | 32 | |
| JBT0305 | Ac-FQSKKNVFVFGYFQGYFERLRAKL-NH2 (SEQ ID NO: 260) | 2.28 | | 45 | |
| JBT0306 | Ac-FQSKKNVFVFGYFSGYFERLRAKL-NH2 (SEQ ID NO: 185) | 3.56 | | 37 | |
| JBT0307 | Ac-FQSKKNVFVFGYFVGYFERLRAKL-NH2 (SEQ ID NO: 261) | 3.42 | | 34 | |
| JBT0308 | Ac-FQSKKKNVFVFGYKERLRAKL-NH2 (SEQ ID NO: 411) | | | 9 | |
| JBT0309 | Ac-FQSKKKNVFVFGYYERLRAKL-NH2 (SEQ ID NO: 412) | 4.50 | | 19 | |

FIG. 22C

| JBT0047 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT0310 | Ac-FQSKKNVFVFGYFDRLRAKL-NH2 (SEQ ID NO: 262) | 3.86 | | 26 | |
| JBT0311 | Ac-FQSKKKNVFVFGYFERLRAKN-NH2 (SEQ ID NO: 748) | | | 5 | |
| JBT0335 | Ac-FQSKKKNVFVFGYFERLRAK-NH2 (SEQ ID NO: 749) | 6.20 | | 2 | |
| JBT0336 | Ac-FQSKNNVFVAGYFDRLRAKL-OH (SEQ ID NO: 263) | 6.52 | | 19 | |
| JBT0337 | Ac-FQSKNNVFVDGYFDRLRAKL-NH2 (SEQ ID NO: 16) | 0.71 | | 51 | |
| JBT0338 | Ac-FQSKNNVFVQGYFDRLRAKL-NH2 (SEQ ID NO: 17) | 1.12 | | 40 | |
| JBT0339 | Ac-FQSKNNVFVSGYFDRLRAKL-NH2 (SEQ ID NO: 18) | 1.22 | | 42 | |
| JBT0340 | Ac-FQSKNNVFVYGYFDRLRAKL-NH2 (SEQ ID NO: 186) | 1.87 | | 37 | |
| JBT0341 | Ac-FQSKNNVFVFGYFDRLRAKL-NH2 (SEQ ID NO: 187) | 1.08 | | 38 | |
| JBT0342 | Ac-FQSKNNVFVDGYFERLRAKL-NH2 (SEQ ID NO: 19) | 0.38 | | 58 | |
| JBT0343 | Ac-FQSKKKNVFVDGYFDRLRAKL-NH2 (SEQ ID NO: 188) | 1.08 | | 34 | |
| JBT0374 | Ac-FQSKDNVFVFGYFERLRAKL-NH2 (SEQ ID NO: 20) | 0.75 | 66 | 52 | 27 |
| JBT0375 | Ac-FQSKGNVFVFGYFERLRAKL-NH2 (SEQ ID NO: 190) | 0.41 | 73 | 65 | 40 |
| JBT0376 | Ac-FQSKKNAFVFGYFERLRAKL-NH2 (SEQ ID NO: 414) | | | 11 | |
| JBT0377 | Ac-FQSKKNQFVFGYFERLRAKL-NH2 (SEQ ID NO: 264) | | | 20 | |
| JBT0378 | Ac-FQSKKNVFVEGYFERLRAKL-NH2 (SEQ ID NO: 21) | 1.59 | 79 | 44 | |
| JBT0379 | Ac-FQSKKNVFVTGYFERLRAKL-NH2 (SEQ ID NO: 22) | 3.13 | 81 | 36 | |
| JBT0380 | Ac-FQSKKNVFVGYFERLRAKL-NH2 (SEQ ID NO: 191) | 2.59 | 73 | 34 | |
| JBT0381 | Ac-FQSPKNVFVFGYFERLRAKL-NH2 (SEQ ID NO: 265) | 3.28 | 81 | 34 | |
| JBT0385 | Ac-FQSKKNNFVFGYFERLRAKL-NH2 (SEQ ID NO: 672) | | | 0 | |
| JBT0386 | Ac-FQSKKNPFVFGYFERLRAKL-NH2 (SEQ ID NO: 415) | | | 6 | |
| JBT0388 | Ac-FQSKKNVHVFGYFERLRAKL-NH2 (SEQ ID NO: 192) | 4.34 | 73 | 26 | |
| JBT0389 | Ac-FQSKKNVVVFGYFERLRAKL-NH2 (SEQ ID NO: 673) | | | 0 | |
| JBT0390 | Ac-FQSKKNVFQFGYFERLRAKL-NH2 (SEQ ID NO: 674) | | | 0 | |

FIG. 22D

| JBT0047 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT0391 | Ac-FQSKKNVFVGGYFERLRAKL-NH2 (SEQ ID NO: 266) | 7.02 | 74 | 18 | |
| JBT0392 | Ac-FQSKKNVFVHGYFERLRAKL-NH2 (SEQ ID NO: 23) | 2.48 | 74 | 37 | |
| JBT0393 | Ac-FQSKKNVFVKGYFERLRAKL-NH2 (SEQ ID NO: 193) | 3.02 | 64 | 28 | |
| JBT0394 | Ac-FQSKKNVFVMGYFERLRAKL-NH2 (SEQ ID NO: 24) | 6.83 | 57 | 12 | |
| JBT0395 | Ac-FQSKKNVFVNGYFERLRAKL-NH2 (SEQ ID NO: 25) | 2.80 | 72 | 32 | |
| JBT0396 | Ac-FQSKKNVFVPGYFERLRAKL-NH2 (SEQ ID NO: 194) | 4.33 | 77 | 30 | |
| JBT0397 | Ac-FQSKKNVFVRGYFERLRAKL-NH2 (SEQ ID NO: 195) | 5.09 | 72 | 23 | |
| JBT0398 | Ac-FQSKKNVFVFGYFEELRAKL-NH2 (SEQ ID NO: 196) | | | 4 | |
| JBT0399 | Ac-FQSKKNVFVFGYFELLRAKL-NH2 (SEQ ID NO: 750) | | | 0 | |
| JBT0400 | Ac-FQSKKNVFVFGYFLRLRAKL-NH2 (SEQ ID NO: 267) | | | 1 | |
| JBT0401 | Ac-FQSKKNVFVFGYFERLRAVL-NH2 (SEQ ID NO: 416) | | | 0 | |
| JBT0402 | Biotin-Ttds-FQSKNNVFVFGYFERLRAKL-NH2 (SEQ ID NO: 973) | 0.32 | 45 | 48 | |
| JBT0403 | Biotin-Ttds-FQSKKNVFVDGYFERLRAKL-NH2 (SEQ ID NO: 972) | 0.49 | 64 | 59 | |
| JBT0404 | Biotin-Ttds-FQSKKNVFVFGYFDRLRAKL-NH2 (SEQ ID NO: 974) | 1.89 | 43 | 24 | |
| JBT0405 | Ac-Ttds-FQSKKNVFVFGYFERLRAKL-NH2 (SEQ ID NO: 975) | 0.86 | 81 | 59 | |
| JBT0406 | Ac-Ttds-FQSKGNVFVTGYFGYFERLRAKL-NH2 (SEQ ID NO: 268) | | | 28 | |
| JBT0471 | Ac-FQSKGNVFVTGYFERLRAKL-NH2 (SEQ ID NO: 26) | 0.41 | 77 | 64 | 45 |
| JBT0472 | Ac-FQSKGNVFVNGYFERLRAKL-NH2 (SEQ ID NO: 27) | 0.37 | 60 | 49 | 34 |
| JBT0473 | Ac-FQSKGNVFVHGYFERLRAKL-NH2 (SEQ ID NO: 28) | 0.25 | 47 | 45 | 31 |
| JBT0474 | Ac-FQSKGNVFVKGYFERLRAKL-NH2 (SEQ ID NO: 29) | 0.29 | 75 | 68 | 50 |
| JBT0475 | Ac-FQSKGNVFVEGYFERLRAKL-NH2 (SEQ ID NO: 30) | 0.25 | 60 | 50 | 37 |
| JBT0476 | Ac-FQSKGNVFVDGYFDRLRAKL-NH2 (SEQ ID NO: 31) | 0.22 | 54 | 49 | 38 |
| JBT0477 | Ac-FQSKGNVFVDGYFERLRAKL-NH2 (SEQ ID NO: 32) | 0.23 | 72 | 68 | 51 |
| JBT0478 | Ac-FQSKDNVFVTGYFERLRAKL-NH2 (SEQ ID NO: 33) | 0.76 | 51 | 39 | 21 |

FIG. 22E

| JBT0047 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0479 | Ac-FQSKDNVFVNGYFERLRAKL-NH2 (SEQ ID NO: 34) | 1.10 | 58 | 40 | 21 |
| JBT0480 | Ac-FQSKDNVFVHGYFERLRAKL-NH2 (SEQ ID NO: 35) | 1.11 | 65 | 42 | 24 |
| JBT0481 | Ac-FQSKDNVFVKGYFERLRAKL-NH2 (SEQ ID NO: 36) | 0.77 | 53 | 41 | 23 |
| JBT0482 | Ac-FQSKDNVFVEGYFERLRAKL-NH2 (SEQ ID NO: 37) | 0.53 | 86 | 69 | 43 |
| JBT0483 | Ac-FQSKDNVFVDGYFERLRAKL-NH2 (SEQ ID NO: 38) | 0.53 | 84 | 68 | 41 |
| JBT0484 | Ac-FQSKDNVFVDGYFDRLRAKL-NH2 (SEQ ID NO: 976) | 0.79 | 73 | 56 | 29 |
| JBT0485 | Ac-FQSKNNVFVTGYFERLRAKL-NH2 (SEQ ID NO: 39) | 0.75 | 86 | 63 | 38 |
| JBT0486 | Ac-FQSKNNVFVNGYFERLRAKL-NH2 (SEQ ID NO: 40) | | | 44 | 26 |
| JBT0487 | Ac-FQSKNNVFVHGYFERLRAKL-NH2 (SEQ ID NO: 41) | | | 58 | 36 |
| JBT0488 | Ac-FQSKNNVFVKGYFERLRAKL-NH2 (SEQ ID NO: 42) | 0.56 | 78 | 64 | 40 |
| JBT0489 | Ac-FQSKNNVFVEGYFERLRAKL-NH2 (SEQ ID NO: 43) | 0.42 | 78 | 68 | 48 |
| JBT0490 | Ac-FQSKQNVFVTGYFERLRAKL-NH2 (SEQ ID NO: 44) | | | 53 | 25 |
| JBT0491 | Ac-FQSKQNVFVNGYFERLRAKL-NH2 (SEQ ID NO: 197) | | | 53 | 29 |
| JBT0492 | Ac-FQSKQNVFVHGYFERLRAKL-NH2 (SEQ ID NO: 198) | | | 45 | 24 |
| JBT0493 | Ac-FQSKQNVFVKGYFERLRAKL-NH2 (SEQ ID NO: 199) | | | 45 | 21 |
| JBT0494 | Ac-FQSKQNVFVDGYFERLRAKL-NH2 (SEQ ID NO: 45) | | | 60 | 36 |
| JBT0495 | Ac-FQSKQNVFVEGYFERLRAKL-NH2 (SEQ ID NO: 200) | 0.47 | | 59 | 36 |
| JBT0497 | Ac-NmetPhe-QSKGNVFVFGYFERLRAKL-NH2 (SEQ ID NO: 201) | | | 40 | 24 |
| JBT0498 | Ac-FQ-NmetSer-KGNVFVFGYFERLRAKL-NH2 (SEQ ID NO: 675 | | | 3 | 1 |
| JBT0499 | Ac-FQS-NmetLys-GNVFVFGYFERLRAKL-NH2 (SEQ ID NO: 202) | 0.83 | 75 | 56 | 30 |
| JBT0500 | Ac-FQSK-NmetGly-NVFVFGYFERLRAKL-NH2 (SEQ ID NO: 46) | 0.13 | 71 | 70 | 60 |
| JBT0501 | Ac-FQSKGN-NmetV-FVFGYFERLRAKL-NH2 (SEQ ID NO: 417) | | | 16 | 6 |
| JBT0502 | Ac-FQSKGNV-NmetPhe-VFGYFERLRAKL-NH2 (SEQ ID NO: 751) | | | 0 | 0 |
| JBT0503 | Ac-FQSKGNVF-NmetV-FGYFERLRAKL-NH2 (SEQ ID NO: 676) | | | 0 | 0 |

FIG. 22F

| JBT0047 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT0504 | Ac-FQSKGNVFV-NmetPhe-GYFERLRAKL-NH2 (SEQ ID NO: 418) | | | 7 | 2 |
| JBT0505 | Ac-FQSKGNVFVF-NmetGly-YFERLRAKL-NH2 (SEQ ID NO: 269) | | | 21 | 7 |
| JBT0506 | Ac-FQSKGNVFVFG-NmetTyr-FERLRAKL-NH2 (SEQ ID NO: 714) | | | 0 | 0 |
| JBT0507 | Ac-FQSKGNVFVFGY-NmetPhe-ERLRAKL-NH2 (SEQ ID NO: 677) | | | 0 | 0 |
| JBT0508 | Ac-FQSKGNVFVFGYF-NmetGlu-RLRAKL-NH2 (SEQ ID NO: 678) | | | 0 | 0 |
| JBT0509 | Ac-FQSKGNVFVFGYFE-Nmr-LRAKL-NH2 (SEQ ID NO: 752) | | | 0 | 0 |
| JBT0510 | Ac-FQSKGNVFVFGYFER-NmetLeu-RAKL-NH2 (SEQ ID NO: 753) | | | 0 | 0 |
| JBT0511 | Ac-FQSKGNVFVFGYFERL-Nmr-AKL-NH2 (SEQ ID NO: 754) | | | 0 | 0 |
| JBT0512 | Ac-FQSKGNVFVFGYFERLR-NmetAla-KL-NH2 (SEQ ID NO: 679) | | | 0 | 0 |
| JBT0513 | Ac-FQSKGNVFVFGYFERLRA-NmetLys-L-NH2 (SEQ ID NO: 755) | | | 0 | 0 |
| JBT0514 | Ac-FQSKGNVFVFGYFERLRAK-NmetLeu-NH2 (SEQ ID NO: 419) | | | 1 | 0 |
| JBT0515 | Ac-bHomoPhe-QSKGNVFVFGYFERLRAKL-NH2 (SEQ ID NO: 420) | | | 22 | 11 |
| JBT0516 | Ac-F-bHomoGln-SKGNVFVFGYFERLRAKL-NH2 (SEQ ID NO: 680) | | | 7 | 4 |
| JBT0517 | Ac-FQ-bHomoSer-KGNVFVFGYFERLRAKL-NH2 (SEQ ID NO: 421) | | | 7 | 2 |
| JBT0518 | Ac-FQS-bHomoLys-GNVFVFGYFERLRAKL-NH2 (SEQ ID NO: 422) | | | 9 | 2 |
| JBT0519 | Ac-FQSK-bAla-NVFVFGYFERLRAKL-NH2 (SEQ ID NO: 270) | | | 20 | 15 |
| JBT0520 | Ac-FQSKG-bGln-VFVFGYFERLRAKL-NH2 (SEQ ID NO: 271) | | | 24 | 9 |
| JBT0521 | Ac-FQSKGN-bLeu-FVFGYFERLRAKL-NH2 (SEQ ID NO: 756) | | | 3 | 3 |
| JBT0522 | Ac-FQSKGNV-bHomoPhe-VFGYFERLRAKL-NH2 (SEQ ID NO: 681) | | | 5 | 3 |
| JBT0523 | Ac-FQSKGNVF-bLeu-FGYFERLRAKL-NH2 (SEQ ID NO: 757) | | | 1 | 2 |
| JBT0524 | Ac-FQSKGNVFV-bHomoPhe-GYFERLRAKL-NH2 (SEQ ID NO: 682) | | | 0 | 4 |
| JBT0525 | Ac-FQSKGNVFVF-bAla-YFERLRAKL-NH2 (SEQ ID NO: 758) | | | 0 | 3 |
| JBT0526 | Ac-FQSKGNVFVFG-bHomoTyr-FERLRAKL-NH2 (SEQ ID NO: 759) | | | 0 | 0 |
| JBT0527 | Ac-FQSKGNVFVFGY-bHomoPhe-ERLRAKL-NH2 (SEQ ID NO: 683) | | | 9 | 2 |

FIG. 22G

| JBT0047 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0528 | Ac-FQSKGNVFVFGYF-bE-RLRAKL-NH2 (SEQ ID NO: 272) | | | 25 | 20 |
| JBT0529 | Ac-FQSKGNVFVFGYFE-bHomoArg-LRAKL-NH2 (SEQ ID NO: 760) | | | 0 | 1 |
| JBT0530 | Ac-FQSKGNVFVFGYFER-Btl-RAKL-NH2 (SEQ ID NO: 684) | | | 3 | 0 |
| JBT0532 | Ac-FQSKGNVFVFGYFERLR-bAla-KL-NH2 (SEQ ID NO: 423) | | | 14 | 7 |
| JBT0533 | Ac-FQSKGNVFVFGYFERLRA-bHomoK-L-NH2 (SEQ ID NO: 424) | | | 17 | 4 |
| JBT0534 | Ac-FQSKGNVFVFGYFERLRAK-Btl-NH2 (SEQ ID NO: 204) | 0.47 | 48 | 39 | 28 |
| JBT0535 | Ac-FQSKGNVFVFGYFE-Cit-LRAKL-NH2 (SEQ ID NO: 685) | | | 13 | 5 |
| JBT0536 | Ac-FQSKGNVFVFGYFERL-Cit-AKL-NH2 (SEQ ID NO: 273) | | | 52 | 32 |
| JBT0537 | Ac-FQSKGNVFVFGYFE-Nle-LRAKL-NH2 (SEQ ID NO: 761) | | | 0 | 0 |
| JBT0538 | Ac-FQSKGNVFVFGYFERL-Nle-AKL-NH2 (SEQ ID NO: 425) | | | 16 | 20 |
| JBT0564 | Ac-FQSKKNVFVFGYFKRLRAKL-NH2 (SEQ ID NO: 205) | 4.12 | 54 | 19 | 6 |
| JBT0578 | Ac-FQSKKKNVFVFGYFRLRAKL-NH2 (SEQ ID NO: 441) | | | 1 | 0 |
| JBT0613 | Ac-FQSKGNVFVFGYFERLRAKL-OH (SEQ ID NO: 283) | | | 21 | 8 |
| JBT0614 | NH2-FQSKGNVFVFGYFERLRAKL-OH (SEQ ID NO: 720) | | | 3 | 0 |
| JBT0615 | NH2-FQSKGNVFVFGYFERLRAKL-NH2 (SEQ ID NO: 284) | | | 14 | 5 |
| JBT0616 | NH2-GSFQSKKNVFVDGYFERLRAKL-OH (SEQ ID NO: 285) | 0.85 | 30 | 25 | |
| JBT0636 | Ac-FQSK-Nmg-NVFVDGYFARLRAKL-NH2 (SEQ ID NO: 47) | 0.10 | 90 | 86 | 76 |
| JBT0651 | Ac-FQSKGNVHVKGYFERLRAKL-NH2 (SEQ ID NO: 48) | 0.59 | 50 | 40 | 26 |
| JBT0652 | Ac-FQSKGNVHVDGYFERLRAKL-NH2 (SEQ ID NO: 49) | 0.34 | 52 | 48 | 34 |
| JBT0653 | Ac-FQSPGNVHVKGYFERLRAKL-NH2 (SEQ ID NO: 50) | 0.44 | 57 | 47 | 33 |
| JBT0654 | Ac-FQSPGNVHVDGYFERLRAKL-NH2 (SEQ ID NO: 51) | 0.37 | 60 | 50 | 36 |
| JBT0655 | Ac-FQSKGNIFVFGYFERLRAKL-NH2 (SEQ ID NO: 52) | 1.32 | 65 | 41 | 22 |
| JBT0656 | Ac-FQSKGNLFVFGYFERLRAKL-NH2 (SEQ ID NO: 286) | | | 21 | 10 |
| JBT0657 | Ac-FQSKGNVFIFGYFERLRAKL-NH2 (SEQ ID NO: 287) | | | 24 | 10 |

FIG. 22H

| JBT0047 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0658 | Ac-FQSKGNVFLFGYFERLRAKL-NH2 (SEQ ID NO: 694) | | | 6 | 3 |
| JBT0663 | Ac-FQSKaNVFVFGYFERLRAKL-NH2 (SEQ ID NO: 53) | 0.29 | 86 | 81 | 60 |
| JBT0668 | Ac-FQSKaNVFVTGYFARLRAKL-NH2 (SEQ ID NO: 54) | 0.52 | 84 | 70 | 43 |
| JBT0681 | Ac-FQSK-Nmg-AVFVFGYFARLRAKL-NH2 (SEQ ID NO: 206) | | | 52 | 52 |
| JBT0683 | Ac-FQSKKAVFVFGYFARLRAKL-NH2 (SEQ ID NO: 55) | 0.13 | 91 | 86 | 74 |
| JBT0696 | Ac-FQSKKAVFVFGYFARLRAKL-NH2 (SEQ ID NO: 288) | 0.71 | 56 | 48 | 26 |
| JBT0697 | Ac-FQSKGNVFVDGYFERL-Dap-AKL-NH2 (SEQ ID NO: 56) | 0.50 | 89 | 73 | 52 |
| JBT0699 | Ac-FQSKGNVFVDGYFERL-Orn-AKL-NH2 (SEQ ID NO: 57) | 0.41 | 89 | 76 | 57 |
| JBT0700 | Ac-FQSKGNVFVDGYFERL-Nva-AKL-NH2 (SEQ ID NO: 58) | 0.19 | 83 | 77 | 64 |
| JBT0704 | Ac-FQSKKNVFVFGYFARLRAKL-NH2 (SEQ ID NO: 289) | | | 19 | 8 |
| JBT0708 | Ac-FQSKaNVFVAGYFERLRAKL-NH2 (SEQ ID NO: 59) | 0.25 | 89 | 77 | 59 |
| JBT0714 | Ac-FQSKaAVFVDGYFARLRAKL-NH2 (SEQ ID NO: 60) | 0.18 | 81 | 75 | 59 |
| JBT0717 | Ac-FQSK-Nmg-NVFVDGYFERLRAKL-NH2 (SEQ ID NO: 61) | 0.06 | 91 | 87 | 84 |
| JBT0720 | Ac-FQSK-Nmg-NVFVTGYFARLRAKL-NH2 (SEQ ID NO: 62) | 0.22 | 85 | 77 | 62 |
| JBT0732 | Ac-FQSKGNVFVDGYFERL-Hci-AKL-NH2 (SEQ ID NO: 63) | 0.18 | 83 | 75 | 62 |
| JBT0733 | Ac-FQSKGNVFVDGYFERL-Har-AKL-NH2 (SEQ ID NO: 64) | 0.18 | 81 | 75 | 62 |
| JBT0739 | Ac-FQSKGNVFVDGYFERL-Opa-AKL-NH2 (SEQ ID NO: 65) | 0.28 | 82 | 74 | 51 |
| JBT0740 | Ac-FQSKGNVFVDGYFERL-Aib-AKL-NH2 (SEQ ID NO: 66) | 0.09 | 87 | 84 | 78 |
| JBT0754 | Ac-FQSK-Nmg-AVFVTGYFARLRAKL-NH2 (SEQ ID NO: 67) | 0.24 | 80 | 74 | 57 |
| JBT0757 | Ac-FQsKKNVFVTGYFERLRAKL-NH2 (SEQ ID NO: 699) | | | 3 | 1 |
| JBT0759 | Ac-FQSKkNVFVFGYFDRLRAKL-NH2 (SEQ ID NO: 207) | 0.65 | 60 | 53 | 29 |
| JBT0765 | Ac-FQSKGNVFVDGYFERL-Eew-AKL-NH2 (SEQ ID NO: 68) | 0.16 | 95 | 87 | 73 |
| JBT0775 | Ac-FQSKGNVFVTGYFDRLRAKL-NH2 (SEQ ID NO: 69) | 0.77 | 77 | 57 | 34 |
| JBT0778 | Ac-FQSKGNVFVKGYFDRLRAKL-NH2 (SEQ ID NO: 209) | 1.48 | 77 | 46 | 23 |

FIG. 22I

| JBT0047 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0779 | Ac-FQSKGNVFVEGYFDRLRAKL-NH2 (SEQ ID NO: 210) | 0.77 | 82 | 59 | 37 |
| JBT0780 | Ac-FQSK-Nmg-NVFVFGYFARLRAKL-NH2 (SEQ ID NO: 70) | | | 45 | 54 |
| JBT0781 | Ac-FQSKGNVFVDGYFKRLRAKL-NH2 (SEQ ID NO: 211) | 1.25 | 81 | 48 | 25 |
| JBT0789 | Ac-FQSK-Nmg-NVFVDGYFERL-Nle-AKL-NH2 (SEQ ID NO: 71) | 0.06 | 86 | 84 | 77 |
| JBT0806 | Ac-FQSK-Nmg-NVFVAGYFARLRAKL-NH2 (SEQ ID NO: 74) | 0.13 | 79 | 75 | 65 |
| JBT0837 | Ac-FQSK-Nng-NVFVTGYFERL-Nle-AKL-NH2 (SEQ ID NO: 213) | 0.20 | 76 | 70 | 54 |
| JBT0844 | Ac-FQSKaNVFVDGYFERLRAKL-NH2 (SEQ ID NO: 300) | 0.32 | 84 | 72 | 51 |
| JBT0850 | Ac-FQSKaAVFVAGYFARLRAKL-NH2 (SEQ ID NO: 302) | 0.19 | 75 | 70 | 55 |
| JBT0854 | Ac-FQSKaAVFVAGYFARL-Nle-AKL-NH2 (SEQ ID NO: 490) | 0.29 | 49 | 47 | 36 |
| JBT0870 | Ac-FQSKaAVFVTGYFARLRAKL-NH2 (SEQ ID NO: 214) | 0.31 | 84 | 80 | 57 |
| JBT0886 | Ac-FQSKaNVFVDGYFARLRAKL-NH2 (SEQ ID NO: 215) | 0.36 | 83 | 71 | 48 |
| JBT0894 | Ac-FQSKGNVFVDGYFERLHAKL-NH2 (SEQ ID NO: 76) | 0.39 | 95 | 80 | 56 |
| JBT0919 | Ac-FQSKaNVFVTGYFERLRAKL-NH2 (SEQ ID NO: 79) | 0.36 | 86 | 74 | 51 |
| JBT0931 | Ac-FQSKGNVFVDGYFERL-Eag-AKL-NH2 (SEQ ID NO: 879) | 0.42 | 91 | 75 | 52 |
| JBT0946 | Ac-FQSKGNVFVDGYFERL-Dab-AKL-NH2 (SEQ ID NO: 85) | 0.27 | 85 | 74 | 56 |
| JBT0950 | Ac-FQSKaNVFVFGYFARLRAKL-NH2 (SEQ ID NO: 217) | | | 47 | 31 |
| JBT0973 | Ac-FQSKGNVFVDGYFERL-Cha-AKL-NH2 (SEQ ID NO: 92) | 0.16 | 70 | 65 | 58 |
| JBT1006 | Ac-FQSKGNVFVDGYFERL-Hie-AKL-NH2 (SEQ ID NO: 96) | 0.17 | 77 | 71 | 61 |
| JBT1035 | Ac-FQSK-Nmg-AVFVAGYFARL-Nle-AKL-NH2 (SEQ ID NO: 218) | | | | 53 |
| JBT1037 | Ac-FQSKGNVFVDGYFERL-Nle-AKL-NH2 (SEQ ID NO: 104) | 0.22 | 74 | 68 | 55 |
| JBT1043 | Ac-FQSKGNVFVDGYFERL-Nle-AKL-NH2 (SEQ ID NO: 106) | 0.30 | 80 | 70 | 51 |
| JBT1082 | Ac-FQSKaAVFVFGYFARLRAKL-NH2 (SEQ ID NO: 565) | 0.20 | 47 | 45 | 38 |
| JBT1084 | Ac-FQSK-Nmg-AVFVAGYFARLRAKL-NH2 (SEQ ID NO: 109) | 0.21 | 66 | 62 | 51 |
| JBT1106 | Ac-FQSKGNVFVDGYFWRLRAKL-NH2 (SEQ ID NO: 220) | 0.28 | 94 | 79 | 65 |

FIG. 22J

| JBT0047 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT1122 | Ac-FQSK-Nmg-NVFVDGYFARL-Nle-AKL-NH2 (SEQ ID NO: 113) | | | 67 | 65 |
| JBT1131 | Biotin-Ttds-FQSKGNVFVDGYFERLRAKL-NH2 (SEQ ID NO: 977) | 0.20 | 94 | 86 | 69 |
| JBT1133 | Ac-FQSKkAVFVDGYFARLRAKL-NH2 (SEQ ID NO: 115) | 0.22 | 80 | 72 | 57 |
| JBT1134 | Ac-FQSKGAVFVDGYFARLRAKL-NH2 (SEQ ID NO: 116) | 0.24 | 72 | 66 | 54 |
| JBT1135 | Ac-FQSKDAVFVDGYFARLRAKL-NH2 (SEQ ID NO: 221) | 0.39 | 68 | 61 | 38 |
| JBT1136 | Ac-FQSKdAVFVDGYFARLRAKL-NH2 (SEQ ID NO: 117) | 0.17 | 77 | 72 | 58 |
| JBT1137 | Ac-FQSKkAVFVAGYFARLRAKL-NH2 (SEQ ID NO: 118) | 0.32 | 71 | 58 | 40 |
| JBT1138 | Ac-FQSKGAVFVAGYFARLRAKL-NH2 (SEQ ID NO: 222) | 0.25 | 50 | 47 | 38 |
| JBT1139 | Ac-FQSKDAVFVAGYFARLRAKL-NH2 (SEQ ID NO: 223) | | | 48 | 26 |
| JBT1140 | Ac-FQSKkAVFVKGYFARLRAKL-NH2 (SEQ ID NO: 119) | 0.21 | 62 | 58 | 47 |
| JBT1141 | Ac-FQSKGAVFVKGYFARLRAKL-NH2 (SEQ ID NO: 120) | 0.37 | 62 | 54 | 38 |
| JBT1142 | Ac-FQSKGAVFVKGYFARLRAKL-NH2 (SEQ ID NO: 224) | 0.39 | 49 | 47 | 32 |
| JBT1143 | Ac-FQSKDAVFVKGYFARLRAKL-NH2 (SEQ ID NO: 225) | 0.84 | 54 | 40 | 19 |
| JBT1144 | Ac-FQSKkAVFVTGYFARLRAKL-NH2 (SEQ ID NO: 121) | 0.32 | 63 | 57 | 38 |
| JBT1145 | Ac-FQSKGAVFVTGYFARLRAKL-NH2 (SEQ ID NO: 122) | 0.39 | 66 | 60 | 38 |
| JBT1146 | Ac-FQSKGAVFVTGYFARLRAKL-NH2 (SEQ ID NO: 226) | | | 41 | 28 |
| JBT1147 | Ac-FQSKDAVFVTGYFARLRAKL-NH2 (SEQ ID NO: 227) | | | 48 | 24 |
| JBT1148 | Ac-FQSKdAVFVTGYFARLRAKL-NH2 (SEQ ID NO: 123) | 0.33 | 68 | 61 | 44 |
| JBT1149 | Ac-FQSKGNVFGYFERLRAKL-NH2 (SEQ ID NO: 936) | | | 0 | 0 |
| JBT1151 | Ac-FQSKKNVFVFGYFERLRAKD-NH2 (SEQ ID NO: 937) | | | 0 | 0 |
| JBT1152 | Ac-FQSKKNVFFFGYFERLRAKL-NH2 (SEQ ID NO: 735) | | | 0 | 0 |
| JBT1153 | Ac-FQSKKNVFVFGYFERLGAKL-NH2 (SEQ ID NO: 705) | 5.25 | 51 | 12 | 0 |
| JBT1155 | Ac-FQSK-Nmg-NVFVTGYFERLRAKL-NH2 (SEQ ID NO: 125) | 0.21 | 87 | 77 | 61 |
| JBT1156 | Ac-FQSKaNVFVDGYFARL-Nle-AKL-NH2 (SEQ ID NO: 126) | | | 67 | 44 |

FIG. 22K

| JBT0047 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT1157 | Ac-FQSKaNVFVAGYFARLRAKL-NH2 (SEQ ID NO: 127) | 0.27 | 77 | 69 | 51 |
| JBT1158 | Ac-FQSKGNVFVFGYFERLRAKL-N-methyl (SEQ ID NO: 228) | | | 73 | 45 |
| JBT1159 | Ac-FQSKGNVFVFGYFERLRAKL-N-ethyl (SEQ ID NO: 128) | | | 71 | 41 |
| JBT1160 | Ac-FQSKGNVFVFGYFERLRAKL-N-propyl (SEQ ID NO: 978) | | | 76 | 54 |
| JBT1161 | Ac-FQSK-Aib-NVFVFGYFERLRAKL-NH2 (SEQ ID NO: 338) | | | 71 | 46 |
| JBT1162 | Ac-FQSKpNVFVFGYFERLRAKL-NH2 (SEQ ID NO: 129) | 0.03 | 94 | 92 | 90 |
| JBT1396 | Ac-FQSK-Nmg-NVFVAGYFERLRAKL-NH2 (SEQ ID NO: 161) | 0.05 | 95 | 93 | 87 |
| JBT1584 | Ac-FQSK-Nmg-NVFVDGYFERL-Aib-AKL-NH2 (SEQ ID NO: 164) | 0.02 | 93 | 93 | 92 |
| JBT1585 | Ac-FQSK-Nmg-NVFVTGYFERL-Aib-AKL-NH2 (SEQ ID NO: 165) | 0.04 | 90 | 90 | 89 |
| JBT1587 | Ac-FQSKGNVFVDGYFERL-Aib-AKLC-NH2 (SEQ ID NO: 167) | 0.05 | 90 | 88 | 83 |
| JBT1590 | Ac-FQSKGNVFV[CGYFERL-Aib-AKLC]-NH2 (SEQ ID NO: 401) | | | 53 | 21 |
| JBT1591 | Ac-FQSKGNVFVDGYF[CRL-Aib-AKLC]-NH2 (SEQ ID NO: 168) | 0.67 | 81 | 72 | 41 |
| JBT1592 | Ac-[CFQSKGNVFVDGYFERLC]AKL-NH2 (SEQ ID NO: 402) | 1.55 | 86 | 54 | 24 |
| JBT1593 | Ac-FQSK[CNVFVDGYFERLC]AKL-NH2 (SEQ ID NO: 670) | | | 43 | 18 |
| JBT1594 | Ac-FQSKGNVFV[CGYFERLC]AKL-NH2 (SEQ ID NO: 671) | | | 9 | 5 |
| JBT1595 | Ac-[CFQSKGNVFVC]GYFERL-Aib-AKL-NH2 (SEQ ID NO: 403) | | | 32 | 14 |
| JBT1596 | Ac-[CFQSKGC]VFVEGYFERL-Aib-AKL-NH2 (SEQ ID NO: 404) | | | 52 | 24 |
| JBT1597 | Ac-DGYFERLRAKL-NH2 (SEQ ID NO: 960) | | | 0 | 0 |
| JBT1598 | Ac-FQSKKNV-NH2 (SEQ ID NO: 961) | | | 0 | 0 |
| JBT1843 | Ac-FQSKGNIFVDGYFERLHAKLRAKL-NH2 (SEQ ID NO: 169) | 0.81 | 94 | 70 | 42 |
| JBT1844 | Ac-FQSKGNNVFVDGYFKRLRAKL-NH2 (SEQ ID NO: 170) | 0.73 | 91 | 70 | 42 |
| JBT1845 | Ac-FQSYKHVFVDGYFERLRAKL-NH2 (SEQ ID NO: 249) | 1.24 | 94 | 61 | 33 |
| JBT1846 | Ac-FQSKGIVFVDGYFKRLRAKL-NH2 (SEQ ID NO: 250) | 0.87 | 91 | 65 | 38 |
| JBT1847 | Ac-YQTKGNVFVDGYFERLRAKL-NH2 (SEQ ID NO: 171) | 0.12 | 87 | 82 | 73 |

FIG. 22L

| JBT0047 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT1852 | PEG(1kD)-FQSKGNVFVDGYFERL-Aib-AKL-NH2 (SEQ ID NO: 174) | 0.11 | 93 | 88 | 76 |
| JBT1853 | PEG(40kD)-FQSKGNVFVDGYFERL-Aib-AKL-NH2 (SEQ ID NO: 175) | 0.17 | 99 | 91 | 75 |
| JBT1854 | Ac-FQSKGNVFVDGYFERL-Aib-AKLC(PEG1kD)-NH2 (SEQ ID NO: 176) | 0.07 | 93 | 90 | 83 |
| JBT1855 | Ac-FQSKGNVFVDGYFERL-Aib-AKLC(PEG40kD)-NH2 (SEQ ID NO: 252) | 0.10 | 97 | 91 | 79 |

FIG. 23A

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0120 | Ac-SGASRYKWF[CGMRDMKGTMSC]VWVKFRYDTS-NH2 (SEQ ID NO: 1047) | 1.21 | 75 | 47 | 26 |
| JBT0124 | Biotin-Ttds-SGASRYKWF[CGMRDMKGTMSC]VWVKFRYDTS-NH2 (SEQ ID NO: 1290) | 1.59 | | 41 | |
| JBT0247 | Ac-SGASRYKWFCGMRDMKGTMSCVWVKFRYDTS-NH2 (SEQ ID NO: 1213) | 0.79 | | 42 | |
| JBT0248 | Ac-KKSGASRYKWF[CGMRDMKGTMSC]VWVKFRYDTSKK-NH2 (SEQ ID NO: 1001) | 0.82 | | 53 | |
| JBT0249 | Ac-KKSGASRYKWFCGMRDMKGTMSKK-NH2 (SEQ ID NO: 1214) | | | 0 | |
| JBT0250 | Ac-KKSRYKWF[CGMRDMKGTMSC]VWKK-NH2 (SEQ ID NO: 1201) | | | 11 | |
| JBT0251 | Ac-KKKWF[CGMRDMKGTMSC]VWVKFKK-NH2 (SEQ ID NO: 1202) | | | 17 | |
| JBT0252 | Ac-KK[CGMRDMKGTMSC]VWVKFRYDKK-NH2 (SEQ ID NO: 1215) | | | 13 | |
| JBT0253 | Ac-KKMRDMKGTMSCVWVKFRYDTSKK-NH2 (SEQ ID NO: 1216) | | | 0 | |
| JBT0319 | Ac-SGASRYKWF[CGMRDMKGTMSC]VWVKFRY-NH2 (SEQ ID NO: 1002) | 0.30 | | 72 | |
| JBT0320 | Ac-SGASRYKWF[CGMRDMKGTMSC]VWVK-NH2 (SEQ ID NO: 1103) | | | 9 | |
| JBT0321 | Ac-SGASRYKWF[CGMRDMKGTMSC]V-NH2 (SEQ ID NO: 1217) | | | 0 | |
| JBT0322 | Ac-SGASRYKWFCGMRDMKGTM-NH2 (SEQ ID NO: 1218) | | | 0 | |
| JBT0323 | Ac-SRYKWF[CGMRDMKGTMSC]VWVKFRYDTS-NH2 (SEQ ID NO: 1076) | 0.72 | | 42 | |
| JBT0324 | Ac-KWF[CGMRDMKGTMSC]VWVKFRYDTS-NH2 (SEQ ID NO: 1155) | | | 0 | |
| JBT0325 | Ac-[CGMRDMKGTMSC]VWVKFRYDTS-NH2 (SEQ ID NO: 1219) | | | 0 | |
| JBT0326 | Ac-RDMKGTMSCVWVKFRYDTS-NH2 (SEQ ID NO: 1220) | | | 0 | |
| JBT0327 | Ac-SGASRYKWF[CGMRDMKGTMS-NH2 (SEQ ID NO: 1222) | | | 0 | |
| JBT0328 | Ac-SRYKWF[CGMRDMKGTMSC]VW-NH2 (SEQ ID NO: 1223) | | | 0 | |
| JBT0329 | Ac-KWF[CGMRDMKGTMSC]VWVKF-NH2 (SEQ ID NO: 1156) | | | 2 | |

FIG. 23B

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0330 | Ac-[CGMRDMKGTMSC]VWVKFRYD-NH2 (SEQ ID NO: 1224) | | | 0 | |
| JBT0331 | Ac-MRDMKGTMSCVWVKFRYDTS-NH2 (SEQ ID NO: 1225) | | | 0 | |
| JBT0332 | Ac-SRYKWFCGMRDMKGTMSCVW-NH2 (SEQ ID NO: 1206) | | | 1 | |
| JBT0333 | Ac-KWFCGMRDMKGTMSCVWVKF-NH2 (SEQ ID NO: 1207) | | | 4 | |
| JBT0334 | Ac-CGMRDMKGTMSCVWVKFRYD-NH2 (SEQ ID NO: 1227) | | | 0 | |
| JBT0409 | Ac-SGASRYKWFSGMRDMKGTMSSVWVKFRYDTS-NH2 (SEQ ID NO: 1204) | | | 0 | |
| JBT0410 | Ac-SGASRYKWFSG-Nle-RD-Nle-KGT-Nle-SSVWVKFRYDTS-NH2 (SEQ ID NO: 1208) | | | 0 | |
| JBT0411 | Ac-SGASRYKWF[CG-Nle-RD-Nle-KGT-Nle-SC]VWVKFRYDTS-NH2 (SEQ ID NO: 1104) | | | 11 | |
| JBT0412 | Ac-KWF[CG-Nle-RD-Nle-KGT-Nle-SC]VWVKF-NH2 (SEQ ID NO: 1209) | | | 7 | |
| JBT0413 | Ac-KWFSGMRDMKGTMSSVWVKF-NH2 (SEQ ID NO: 1228) | | | 0 | |
| JBT0414 | Ac-KWFSG-Nle-RD-Nle-KGT-Nle-SSVWVKF-NH2 (SEQ ID NO: 1205) | | | 4 | |
| JBT0415 | Ac-SRYKWF[CGMRDMKGTMSC]VWVKF-NH2 (SEQ ID NO: 1003) | 0.52 | 73 | 59 | 39 |
| JBT0416 | Ac-SRYKWF[CG-Nle-RD-Nle-KGT-Nle-SC]VWVKF-NH2 (SEQ ID NO: 1077) | | | 52 | |
| JBT0417 | Ac-SRYKWFSGMRDMKGTMSSVWVKF-NH2 (SEQ ID NO: 1229) | | | 0 | |
| JBT0418 | Ac-SRYKWFSG-Nle-RD-Nle-KGT-Nle-SSVWVKF-NH2 (SEQ ID NO: 1293) | | | 4 | |
| JBT0419 | Ac-SGGRKHKHFLRSNGKPSRALSSMHFWRWSTS-NH2 (SEQ ID NO: 1211) | | | 6 | |
| JBT0435 | Ac-RKRDVSGKM[CWSGFGSKWFRC]ADMMTYYSVT-NH2 (SEQ ID NO: 1211) | | | 0 | |
| JBT0436 | Ac-RWSGKSTYS[CDAMVRRMGMKC]FSFGWTDVYK-NH2 (SEQ ID NO: 1212) | | | 0 | |
| JBT0437 | Ac-ARYKWF[CGMRDMKGTMSC]VWVKF-NH2 (SEQ ID NO: 1048) | | | 71 | |
| JBT0438 | Ac-SAYKWF[CGMRDMKGTMSC]VWVKF-NH2 (SEQ ID NO: 1078) | | | 54 | |
| JBT0439 | Ac-SRAKWF[CGMRDMKGTMSC]VWVKF-NH2 (SEQ ID NO: 1105) | | | 35 | |
| JBT0440 | Ac-SRYAWF[CGMRDMKGTMSC]VWVKF-NH2 (SEQ ID NO: 1106) | | | 37 | |
| JBT0441 | Ac-SRYKAF[CGMRDMKGTMSC]VWVKF-NH2 (SEQ ID NO: 1230) | | | 0 | |

FIG. 23C

| JBT0120 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT0442 | Ac-SRYKWA[CGMRDMKGTMSC]VWVKF-NH2 (SEQ ID NO: 1231) | | | 8 | |
| JBT0443 | Ac-SRYKWFAGMRDMKGTMSCVWVKF-NH2 (SEQ ID NO: 1157) | | | 0 | |
| JBT0444 | Ac-SRYKWF[CAMRDMKGTMSC]VWVKF-NH2 (SEQ ID NO: 1004) | 0.24 | 90 | 80 | 62 |
| JBT0445 | Ac-SRYKWF[CGARDMKGTMSC]VWVKF-NH2 (SEQ ID NO: 1107) | | | 18 | |
| JBT0446 | Ac-SRYKWF[CGMADMKGTMSC]VWVKF-NH2 (SEQ ID NO: 1079) | | | 50 | |
| JBT0447 | Ac-SRYKWF[CGMRAMKGTMSC]VWVKF-NH2 (SEQ ID NO: 1158) | | | 11 | |
| JBT0448 | Ac-SRYKWF[CGMRDAKGTMSC]VWVKF-NH2 (SEQ ID NO: 1108) | | | 44 | |
| JBT0449 | Ac-SRYKWF[CGMRDMAGTMSC]VWVKF-NH2 (SEQ ID NO: 1080) | 1.26 | 82 | 46 | 30 |
| JBT0450 | Ac-SRYKWF[CGMRDMKATMSC]VWVKF-NH2 (SEQ ID NO: 1159) | | | 33 | |
| JBT0451 | Ac-SRYKWF[CGMRDMKGAMSC]VWVKF-NH2 (SEQ ID NO: 1081) | | | 54 | |
| JBT0452 | Ac-SRYKWF[CGMRDMKGTASC]VWVKF-NH2 (SEQ ID NO: 1109) | | | 39 | |
| JBT0453 | Ac-SRYKWF[CGMRDMKGTMAC]VWVKF-NH2 (SEQ ID NO: 1110) | 1.18 | 62 | 38 | 23 |
| JBT0454 | Ac-SRYKWFCGMRDMKGTMSAVWVKF-NH2 (SEQ ID NO: 1160) | | | 0 | |
| JBT0455 | Ac-SRYKWF[CGMRDMKGTMSC]AWVKF-NH2 (SEQ ID NO: 1049) | 1.02 | 65 | 40 | 26 |
| JBT0456 | Ac-SRYKWFCGMRDMKGTMSCVAVKF-NH2 (SEQ ID NO: 1232) | | | 3 | |
| JBT0457 | Ac-SRYKWF[CGMRDMKGTMSC]VWAKF-NH2 (SEQ ID NO: 1161) | | | 16 | |
| JBT0458 | Ac-SRYKWF[CGMRDMKGTMSC]VWVAF-NH2 (SEQ ID NO: 1082) | 1.34 | 66 | 39 | 24 |
| JBT0459 | Ac-SRYKWF[CGMRDMKGTMSC]VWVKA-NH2 (SEQ ID NO: 1083) | | | 47 | |
| JBT0460 | Ac-RYKWF[CGMRDMKGTMSC]VWVKF-NH2 (SEQ ID NO: 1050) | | | 57 | |
| JBT0461 | Ac-YKWF[CGMRDMKGTMSC]VWVKF-NH2 (SEQ ID NO: 1111) | | | 32 | |
| JBT0462 | Ac-SRYKWFGM[CRDMKGTMSC]VWVKF-NH2 (SEQ ID NO: 1233) | | | 0 | |
| JBT0463 | Ac-SRYKWFGMRD[CMKGTMSC]VWVKF-NH2 (SEQ ID NO: 1234) | | | 0 | |
| JBT0464 | Ac-SRYKWFGMRDMK[CGTMSC]VWVKF-NH2 (SEQ ID NO: 1235) | | | 0 | |
| JBT0465 | Ac-SRYKWF[CGMRDMKGTC]MSVWVKF-NH2 (SEQ ID NO: 1236) | | | 0 | |
| JBT0466 | Ac-SRYKWF[CGMRDMKC]GTMSVWVKF-NH2 (SEQ ID NO: 1237) | | | 0 | |

FIG. 23D

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0467 | Ac-SRYKWF[CGMRDC]MKGTMSVWVKF-NH2 (SEQ ID NO: 1238) | | | 0 | |
| JBT0468 | Ac-SRYKWFG[CMRDMKGTMC]SVWVKF-NH2 (SEQ ID NO: 1239) | | | 2 | |
| JBT0469 | Ac-SRYKWFGM[CRDMKGTC]MSVWVKF-NH2 (SEQ ID NO: 1240) | | | 5 | |
| JBT0470 | Ac-SRYKWFGMR[CDMKGC]TMSVWVKF-NH2 (SEQ ID NO: 1162) | | | 0 | |
| JBT0617 | Ac-SRYKWF[homoC-GMRDMKGTMSC]VWVKF-NH2 (SEQ ID NO: 1112) | 1.91 | 35 | 18 | 8 |
| JBT0618 | Ac-SRYKWF[CGMRDMKGTMS-homoC]VWVKF-NH2 (SEQ ID NO: 1163) | 3.44 | 18 | 5 | 1 |
| JBT0619 | Ac-SRYKWF[homoC-GMRDMKGTMS-homoC]VWVKF-NH2 (SEQ ID NO: 1241) | | | 0 | 0 |
| JBT0620 | Ac-SRYKWF[Dap-GMRDMKGTMS-D]VWVKF-NH2 (SEQ ID NO: 1242) | | | 0 | 0 |
| JBT0623 | Ac-SRYKWF[KGMRDMKGTMSD]VWVKF-NH2 (SEQ ID NO: 1243) | | | 3 | 2 |
| JBT0625 | Ac-SRYKWF[CMRDMKGTMSC]VWVKF-NH2 (SEQ ID NO: 1244) | | | 0 | 0 |
| JBT0626 | Ac-SRYKWF[CGMRDKGTMSC]VWVKF-NH2 (SEQ ID NO: 1164) | | | 3 | 0 |
| JBT0627 | Ac-SRYKWF[CGMRDMGTMSC]VWVKF-NH2 (SEQ ID NO: 1165) | | | 2 | 0 |
| JBT0628 | Ac-SRYKWF[CGMRDMKGMSC]VWVKF-NH2 (SEQ ID NO: 1166) | | | 0 | 0 |
| JBT0629 | Ac-SRYKWF[cGMRDMKGTMSC]VWVKF-NH2 (SEQ ID NO: 1167) | | | 0 | 0 |
| JBT0631 | Ac-SRYKWF[CGmRDMKGTMSC]VWVKF-NH2 (SEQ ID NO: 1113) | 1.89 | 62 | 33 | 15 |
| JBT0632 | Ac-SRYKWF[CGMrDMKGTMSC]VWVKF-NH2 (SEQ ID NO: 1245) | | | 0 | 0 |
| JBT0633 | Ac-SRYKWF[CGMRdMKGTMSC]VWVKF-NH2 (SEQ ID NO: 1168) | | | 0 | 0 |
| JBT0634 | Ac-SRYKWF[CGMRDmKGTMSC]VWVKF-NH2 (SEQ ID NO: 1051) | 0.69 | 63 | 47 | 26 |
| JBT0635 | Ac-SRYKWF[CGMRDMkGTMSC]VWVKF-NH2 (SEQ ID NO: 1114) | 5.14 | 48 | 13 | 2 |
| JBT0637 | Ac-SRYKWF[CGMRDMKgtMSC]VWVKF-NH2 (SEQ ID NO: 1169) | | | 0 | 0 |
| JBT0638 | Ac-SRYKWF[CGMRDMKGTmSC]VWVKF-NH2 (SEQ ID NO: 1246) | | | 0 | 0 |
| JBT0639 | Ac-SRYKWF[CGMRDMKGTMsC]VWVKF-NH2 (SEQ ID NO: 1170) | | | 2 | 0 |
| JBT0640 | Ac-SRYKWF[CGMRDMKGTMSc]VWVKF-NH2 (SEQ ID NO: 1171) | | | 3 | 0 |
| JBT0641 | Ac-SRYKWF[CPMRDMKGTMSC]VWVKF-NH2 (SEQ ID NO: 1247) | | | 4 | 2 |
| JBT0642 | Ac-SRYKWF[CGPRDMKGTMSC]VWVKF-NH2 (SEQ ID NO: 1248) | | | 2 | 1 |

FIG. 23E

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0643 | Ac-SRYKWF[CGMPDMKGTMSC]VWVKF-NH2 (SEQ ID NO: 1006) | | | 45 | 26 |
| JBT0644 | Ac-SRYKWF[CGMRPMKGTMSC]VWVKF-NH2 (SEQ ID NO: 1172) | 4.55 | 35 | 12 | 3 |
| JBT0645 | Ac-SRYKWF[CGMRDPKGTMSC]VWVKF-NH2 (SEQ ID NO: 1084) | 3.79 | 62 | 27 | 12 |
| JBT0646 | Ac-SRYKWF[CGMRDMPGTMSC]VWVKF-NH2 (SEQ ID NO: 1173) | | | 4 | 1 |
| JBT0647 | Ac-SRYKWF[CGMRDMKPTMSC]VWVKF-NH2 (SEQ ID NO: 1249) | | | 4 | 2 |
| JBT0648 | Ac-SRYKWF[CGMRDMKGPMSC]VWVKF-NH2 (SEQ ID NO: 1174) | | | 4 | 0 |
| JBT0649 | Ac-SRYKWF[CGMRDMKGTPSC]VWVKF-NH2 (SEQ ID NO: 1175) | | | 5 | 2 |
| JBT0650 | Ac-SRYKWF[CGMRDMKGTMPC]VWVKF-NH2 (SEQ ID NO: 1250) | | | 0 | 0 |
| JBT0659 | Biotinyl-Ttds-SRYKWF[CGMRDMKGTMSC]VWVKF-NH2 (SEQ ID NO: 1291) | | | 63 | 38 |
| JBT0787 | Ac-SRYKWF[CG-SeMet-RD-SeMet-KGT-SeMet-SC]VWVKF-NH2 (SEQ ID NO: 1292) | | | 68 | 56 |
| JBT1416 | Ac-DRYKWF[CGMRDMKGTMSC]VWVKF-NH2 (SEQ ID NO: 1007) | 0.58 | 93 | 68 | 46 |
| JBT1417 | Ac-SDYKWF[CGMRDMKGTMSC]VWVKF-NH2 (SEQ ID NO: 1116) | | | 34 | 13 |
| JBT1418 | Ac-SRDKWF[CGMRDMKGTMSC]VWVKF-NH2 (SEQ ID NO: 1176) | | | 15 | 5 |
| JBT1419 | Ac-SRYDWF[CGMRDMKGTMSC]VWVKF-NH2 (SEQ ID NO: 1117) | | | 31 | 10 |
| JBT1420 | Ac-SRYKDF[CGMRDMKGTMSC]VWVKF-NH2 (SEQ ID NO: 1251) | | | 0 | 0 |
| JBT1421 | Ac-SRYKWD[CGMRDMKGTMSC]VWVKF-NH2 (SEQ ID NO: 1252) | | | 2 | 2 |
| JBT1422 | Ac-SRYKWF[CDMRDMKGTMSC]VWVKF-NH2 (SEQ ID NO: 1253) | | | 0 | 0 |
| JBT1423 | Ac-SRYKWF[CGDRDMKGTMSC]VWVKF-NH2 (SEQ ID NO: 1177) | | | 1 | 0 |
| JBT1424 | Ac-SRYKWF[CGMDDMKGTMSC]VWVKF-NH2 (SEQ ID NO: 1254) | | | 4 | 1 |
| JBT1425 | Ac-SRYKWF[CGMRDDKGTMSC]VWVKF-NH2 (SEQ ID NO: 1085) | | | 53 | 28 |
| JBT1426 | Ac-SRYKWF[CGMRDMDGTMSC]VWVKF-NH2 (SEQ ID NO: 1008) | 0.19 | 96 | 81 | 66 |
| JBT1427 | Ac-SRYKWF[CGMRDMKDTMSC]VWVKF-NH2 (SEQ ID NO: 1052) | | | 57 | 31 |
| JBT1428 | Ac-SRYKWF[CGMRDMKGDMSC]VWVKF-NH2 (SEQ ID NO: 1118) | | | 28 | 6 |
| JBT1429 | Ac-SRYKWF[CGMRDMKGTDSC]VWVKF-NH2 (SEQ ID NO: 1086) | | | 49 | 21 |

FIG. 23F

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT1430 | Ac-SRYKWF[CGMRDMKGTMDC]VWVKF-NH2 (SEQ ID NO: 1119) | | | 37 | 15 |
| JBT1431 | Ac-SRYKWF[CGMRDMKGTMSC]DWVKF-NH2 (SEQ ID NO: 1255) | | | 0 | 0 |
| JBT1432 | Ac-SRYKWF[CGMRDMKGTMSC]VDVKF-NH2 (SEQ ID NO: 1256) | | | 0 | 0 |
| JBT1433 | Ac-SRYKWF[CGMRDMKGTMSC]VWDKF-NH2 (SEQ ID NO: 1257) | | | 0 | 0 |
| JBT1434 | Ac-SRYKWF[CGMRDMKGTMSC]VWVDF-NH2 (SEQ ID NO: 1120) | | | 28 | 9 |
| JBT1435 | Ac-SRYKWF[CGMRDMKGTMSC]VWVKD-NH2 (SEQ ID NO: 1009) | | | 61 | 34 |
| JBT1436 | Ac-FRYKWF[CGMRDMKGTMSC]VWVKF-NH2 (SEQ ID NO: 1053) | 0.68 | 95 | 71 | 45 |
| JBT1437 | Ac-SFYKWF[CGMRDMKGTMSC]VWVKF-NH2 (SEQ ID NO: 1010) | 0.27 | 95 | 80 | 64 |
| JBT1438 | Ac-SRFKWF[CGMRDMKGTMSC]VWVKF-NH2 (SEQ ID NO: 1011) | 0.69 | 88 | 64 | 43 |
| JBT1439 | Ac-SRYFWF[CGMRDMKGTMSC]VWVKF-NH2 (SEQ ID NO: 1121) | | | 35 | 14 |
| JBT1440 | Ac-SRYKFF[CGMRDMKGTMSC]VWVKF-NH2 (SEQ ID NO: 1258) | | | 3 | 2 |
| JBT1441 | Ac-SRYKWF[CFMRDMKGTMSC]VWVKF-NH2 (SEQ ID NO: 1259) | | | 7 | 4 |
| JBT1442 | Ac-SRYKWF[CGFRDMKGTMSC]VWVKF-NH2 (SEQ ID NO: 1778) | | | 10 | 3 |
| JBT1443 | Ac-SRYKWF[CGMFDMKGTMSC]VWVKF-NH2 (SEQ ID NO: 1779) | | | 22 | 7 |
| JBT1444 | Ac-SRYKWF[CGMRFMKGTMSC]VWVKF-NH2 (SEQ ID NO: 1260) | | | 7 | 5 |
| JBT1445 | Ac-SRYKWF[CGMRDFKGTMSC]VWVKF-NH2 (SEQ ID NO: 1012) | 0.77 | 89 | 64 | 41 |
| JBT1446 | Ac-SRYKWF[CGMRDMFGTMSC]VWVKF-NH2 (SEQ ID NO: 1054) | 0.68 | 93 | 69 | 45 |
| JBT1447 | Ac-SRYKWF[CGMRDMKFTMSC]VWVKF-NH2 (SEQ ID NO: 1227) | | | 46 | 21 |
| JBT1448 | Ac-SRYKWF[CGMRDMKGFMSC]VWVKF-NH2 (SEQ ID NO: 1123) | 0.99 | 86 | 60 | 34 |
| JBT1449 | Ac-SRYKWF[CGMRDMKGTFSC]VWVKF-NH2 (SEQ ID NO: 1013) | 0.40 | 89 | 74 | 53 |
| JBT1450 | Ac-SRYKWF[CGMRDMKGTMFC]VWVKF-NH2 (SEQ ID NO: 1124) | | | 44 | 17 |
| JBT1451 | Ac-SRYKWF[CGMRDMKGTMSC]FWVKF-NH2 (SEQ ID NO: 1087) | | | 34 | 11 |
| JBT1452 | Ac-SRYKWF[CGMRDMKGTMSC]VFVKF-NH2 (SEQ ID NO: 1125) | | | 27 | 5 |
| JBT1453 | Ac-SRYKWF[CGMRDMKGTMSC]VWFKF-NH2 (SEQ ID NO: 1261) | | | 6 | 1 |
| JBT1454 | Ac-SRYKWF[CGMRDMKGTMSC]VWVFF-NH2 (SEQ ID NO: 1262) | | | 47 | 22 |

FIG. 23G

| JBT0120 class | | | FXa Inhibition assay | | | |
|---|---|---|---|---|---|---|
| Peptide | Sequence | | EC50 (µM) | Maximal inhibition (%) | % Inhibition @ 2.5µM | % Inhibition @ 0.63µM |
| JBT1455 | Ac-GRYKWF[CGMRDMKGTMSC]VWVKF-NH2 (SEQ ID NO: 1014) | | 0.79 | 87 | 62 | 40 |
| JBT1456 | Ac-SGYKWF[CGMRDMKGTMSC]VWVKF-NH2 (SEQ ID NO: 1126) | | | | 41 | 15 |
| JBT1457 | Ac-SRGKWF[CGMRDMKGTMSC]VWVKF-NH2 (SEQ ID NO: 1180) | | | | 15 | 4 |
| JBT1458 | Ac-SRYGWF[CGMRDMKGTMSC]VWVKF-NH2 (SEQ ID NO: 1127) | | | | 32 | 10 |
| JBT1459 | Ac-SRYKGF[CGMRDMKGTMSC]VWVKF-NH2 (SEQ ID NO: 1263) | | | | 0 | 0 |
| JBT1460 | Ac-SRYKWG[CGMRDMKGTMSC]VWVKF-NH2 (SEQ ID NO: 1264) | | | | 0 | 0 |
| JBT1461 | Ac-SRYKWF[CGGRDMKGTMSC]VWVKF-NH2 (SEQ ID NO: 1181) | | | | 8 | 0 |
| JBT1462 | Ac-SRYKWF[CGMGDMKGTMSC]VWVKF-NH2 (SEQ ID NO: 1128) | | | | 33 | 15 |
| JBT1463 | Ac-SRYKWF[CGMRGMKGTMSC]VWVKF-NH2 (SEQ ID NO: 1129) | | | | 23 | 10 |
| JBT1464 | Ac-SRYKWF[CGMRDGKGTMSC]VWVKF-NH2 (SEQ ID NO: 1088) | | | | 50 | 25 |
| JBT1465 | Ac-SRYKWF[CGMRDMGGTMSC]VWVKF-NH2 (SEQ ID NO: 1015) | | 0.84 | 92 | 60 | 41 |
| JBT1466 | Ac-SRYKWF[CGMRDMKGGMSC]VWVKF-NH2 (SEQ ID NO: 1055) | | | | 53 | 26 |
| JBT1467 | Ac-SRYKWF[CGMRDMKGTGSC]VWVKF-NH2 (SEQ ID NO: 1130) | | | | 27 | 11 |
| JBT1468 | Ac-SRYKWF[CGMRDMKGTMGC]VWVKF-NH2 (SEQ ID NO: 1131) | | | | 25 | 9 |
| JBT1469 | Ac-SRYKWF[CGMRDMKGTMSC]GWVKF-NH2 (SEQ ID NO: 1182) | | | | 4 | 0 |
| JBT1470 | Ac-SRYKWF[CGMRDMKGTMSC]VGVKF-NH2 (SEQ ID NO: 1265) | | | | 0 | 0 |
| JBT1471 | Ac-SRYKWF[CGMRDMKGTMSC]VWGKF-NH2 (SEQ ID NO: 1266) | | | | 4 | 0 |
| JBT1472 | Ac-SRYKWF[CGMRDMKGTMSC]VWVGF-NH2 (SEQ ID NO: 1089) | | | | 48 | 21 |
| JBT1473 | Ac-SRYKWF[CGMRDMKGTMSC]VWVKG-NH2 (SEQ ID NO: 1090) | | | | 40 | 16 |
| JBT1474 | Ac-KRYKWF[CGMRDMKGTMSC]VWVKF-NH2 (SEQ ID NO: 1016) | | 0.37 | 90 | 75 | 55 |
| JBT1475 | Ac-SKYKWF[CGMRDMKGTMSC]VWVKF-NH2 (SEQ ID NO: 1056) | | | | 63 | 37 |
| JBT1476 | Ac-SRKKWF[CGMRDMKGTMSC]VWVKF-NH2 (SEQ ID NO: 1132) | | | | 31 | 11 |
| JBT1477 | Ac-SRYKKF[CGMRDMKGTMSC]VWVKF-NH2 (SEQ ID NO: 1267) | | | | 0 | 0 |
| JBT1478 | Ac-SRYKWK[CGMRDMKGTMSC]VWVKF-NH2 (SEQ ID NO: 1091) | | | | 45 | 18 |
| JBT1479 | Ac-SRYKWF[CKMRDMKGTMSC]VWVKF-NH2 (SEQ ID NO: 1183) | | | | 14 | 2 |

FIG. 23H

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT1480 | Ac-SRYKWF[CGKRDMKGTMSC]VWVKF-NH2 (SEQ ID NO: 1133) | | | 27 | 9 |
| JBT1481 | Ac-SRYKWF[CGMKDMKGTMSC]VWVKF-NH2 (SEQ ID NO: 1017) | 0.37 | 88 | 71 | 54 |
| JBT1482 | Ac-SRYKWF[CGMRKMKGTMSC]VWVKF-NH2 (SEQ ID NO: 1184) | | | 9 | 1 |
| JBT1483 | Ac-SRYKWF[CGMRDKKGTMSC]VWVKF-NH2 (SEQ ID NO: 1057) | 0.99 | 83 | 60 | 32 |
| JBT1484 | Ac-SRYKWF[CGMRDMKKTMSC]VWVKF-NH2 (SEQ ID NO: 1134) | | | 30 | 10 |
| JBT1485 | Ac-SRYKWF[CGMRDMKGKMSC]VWVKF-NH2 (SEQ ID NO: 1058) | | | 56 | 32 |
| JBT1486 | Ac-SRYKWF[CGMRDMKGTKSC]VWVKF-NH2 (SEQ ID NO: 1059) | | | 58 | 34 |
| JBT1487 | Ac-SRYKWF[CGMRDMKGTMKC]VWVKF-NH2 (SEQ ID NO: 1135) | | | 30 | 9 |
| JBT1488 | Ac-SRYKWF[CGMRDMKGTMSC]KWVKF-NH2 (SEQ ID NO: 1268) | | | 3 | 0 |
| JBT1489 | Ac-SRYKWF[CGMRDMKGTMSC]VKVKF-NH2 (SEQ ID NO: 1269) | | | 0 | 0 |
| JBT1490 | Ac-SRYKWF[CGMRDMKGTMSC]VWKKF-NH2 (SEQ ID NO: 1270) | | | 0 | 1 |
| JBT1491 | Ac-SRYKWF[CGMRDMKGTMSC]VWVKK-NH2 (SEQ ID NO: 1136) | | | 26 | 6 |
| JBT1492 | Ac-LRYKWF[CGMRDMKGTMSC]VWVKF-NH2 (SEQ ID NO: 1018) | 0.47 | 91 | 72 | 52 |
| JBT1493 | Ac-SLYKWF[CGMRDMKGTMSC]VWVKF-NH2 (SEQ ID NO: 1060) | 0.48 | 96 | 74 | 54 |
| JBT1494 | Ac-SRLKWF[CGMRDMKGTMSC]VWVKF-NH2 (SEQ ID NO: 1137) | | | 22 | 6 |
| JBT1495 | Ac-SRYLWF[CGMRDMKGTMSC]VWVKF-NH2 (SEQ ID NO: 1138) | | | 30 | 10 |
| JBT1496 | Ac-SRYKLF[CGMRDMKGTMSC]VWVKF-NH2 (SEQ ID NO: 1271) | | | 0 | 0 |
| JBT1497 | Ac-SRYKWL[CGMRDMKGTMSC]VWVKF-NH2 (SEQ ID NO: 1061) | | | 58 | 33 |
| JBT1498 | Ac-SRYKWF[CLMRDMKGTMSC]VWVKF-NH2 (SEQ ID NO: 1272) | | | 3 | 1 |
| JBT1499 | Ac-SRYKWF[CGLRDMKGTMSC]VWVKF-NH2 (SEQ ID NO: 1139) | | | 21 | 7 |
| JBT1500 | Ac-SRYKWF[CGMLDMKGTMSC]VWVKF-NH2 (SEQ ID NO: 1062) | | | 60 | 34 |
| JBT1501 | Ac-SRYKWF[CGMRLMKGTMSC]VWVKF-NH2 (SEQ ID NO: 1185) | | | 14 | 3 |
| JBT1502 | Ac-SRYKWF[CGMRDLKGTMSC]VWVKF-NH2 (SEQ ID NO: 1019) | 0.33 | 93 | 76 | 59 |
| JBT1503 | Ac-SRYKWF[CGMRDMLGTMSC]VWVKF-NH2 (SEQ ID NO: 1063) | 0.53 | 83 | 66 | 44 |
| JBT1504 | Ac-SRYKWF[CGMRDMKLTMSC]VWVKF-NH2 (SEQ ID NO: 1140) | | | 37 | 13 |

FIG. 231

| JBT0120 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT1505 | Ac-SRYKWF[CGMRDMKGLMSC]VWVKF-NH2 (SEQ ID NO: 1092) | | | 66 | 42 |
| JBT1506 | Ac-SRYKWF[CGMRDMKGTLSC]VWVKF-NH2 (SEQ ID NO: 1064) | 0.89 | 91 | 63 | 39 |
| JBT1507 | Ac-SRYKWF[CGMRDMKGTMLC]VWVKF-NH2 (SEQ ID NO: 10141) | | | 35 | 11 |
| JBT1508 | Ac-SRYKWF[CGMRDMKGTMSC]LWVKF-NH2 (SEQ ID NO: 1093) | | | 52 | 27 |
| JBT1509 | Ac-SRYKWF[CGMRDMKGTMSC]VLVKF-NH2 (SEQ ID NO: 1273) | | | 3 | 0 |
| JBT1510 | Ac-SRYKWF[CGMRDMKGTMSC]VWLKF-NH2 (SEQ ID NO: 1094) | | | 51 | 27 |
| JBT1511 | Ac-SRYKWF[CGMRDMKGTMSC]VWVLF-NH2 (SEQ ID NO: 1142) | | | 52 | 27 |
| JBT1512 | Ac-SRYKWF[CGMRDMKGTMSC]VWVKL-NH2 (SEQ ID NO: 1020) | 0.37 | 91 | 72 | 55 |
| JBT1513 | Ac-SSYKWF[CGMRDMKGTMSC]VWVKF-NH2 (SEQ ID NO: 1065) | | | 63 | 40 |
| JBT1514 | Ac-SRSKWF[CGMRDMKGTMSC]VWVKF-NH2 (SEQ ID NO: 1066) | | | 51 | 27 |
| JBT1515 | Ac-SRYSWF[CGMRDMKGTMSC]VWVKF-NH2 (SEQ ID NO: 1143) | | | 32 | 11 |
| JBT1516 | Ac-SRYKSF[CGMRDMKGTMSC]VWVKF-NH2 (SEQ ID NO: 1274) | | | 0 | 0 |
| JBT1517 | Ac-SRYKWS[CGMRDMKGTMSC]VWVKF-NH2 (SEQ ID NO: 1275) | | | 1 | 0 |
| JBT1518 | Ac-SRYKWF[CSMRDMKGTMSC]VWVKF-NH2 (SEQ ID NO: 1021) | | | 62 | 39 |
| JBT1519 | Ac-SRYKWF[CGSRDMKGTMSC]VWVKF-NH2 (SEQ ID NO: 1186) | | | 11 | 3 |
| JBT1520 | Ac-SRYKWF[CGMSDMKGTMSC]VWVKF-NH2 (SEQ ID NO: 1095) | | | 45 | 20 |
| JBT1521 | Ac-SRYKWF[CGMRSMKGTMSC]VWVKF-NH2 (SEQ ID NO: 1096) | | | 44 | 21 |
| JBT1522 | Ac-SRYKWF[CGMRDSKGTMSC]VWVKF-NH2 (SEQ ID NO: 1067) | | | 56 | 32 |
| JBT1523 | Ac-SRYKWF[CGMRDMSGTMSC]VWVKF-NH2 (SEQ ID NO: 1022) | 0.50 | 91 | 70 | 51 |
| JBT1524 | Ac-SRYKWF[CGMRDMKSTMSC]VWVKF-NH2 (SEQ ID NO: 1144) | | | 39 | 16 |
| JBT1525 | Ac-SRYKWF[CGMRDMKGSMSC]VWVKF-NH2 (SEQ ID NO: 1068) | | | 68 | 46 |
| JBT1526 | Ac-SRYKWF[CGMRDMKGTSSC]VWVKF-NH2 (SEQ ID NO: 1069) | | | 53 | 32 |
| JBT1527 | Ac-SRYKWF[CGMRDMKGTMSC]SWVKF-NH2 (SEQ ID NO: 1097) | | | 43 | 20 |
| JBT1528 | Ac-SRYKWF[CGMRDMKGTMSC]VSVKF-NH2 (SEQ ID NO: 1276) | | | 2 | 0 |
| JBT1529 | Ac-SRYKWF[CGMRDMKGTMSC]VWSKF-NH2 (SEQ ID NO: 1277) | | | 1 | 0 |

FIG. 23J

| JBT0120 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT1530 | Ac-SRYKWF[CGMRDMKGTMSC]VWVSF-NH2 (SEQ ID NO: 1070) | | | 54 | 31 |
| JBT1531 | Ac-SRYKWF[CGMRDMKGTMSC]VWVKS-NH2 (SEQ ID NO: 1071) | | | 50 | 28 |
| JBT1532 | Ac-PRYKWF[CGMRDMKGTMSC]VWVKF-NH2 (SEQ ID NO: 1072) | | | 62 | 38 |
| JBT1533 | Ac-SPYKWF[CGMRDMKGTMSC]VWVKF-NH2 (SEQ ID NO: 1145) | | | 31 | 10 |
| JBT1534 | Ac-SRPKWF[CGMRDMKGTMSC]VWVKF-NH2 (SEQ ID NO: 1187) | | | 2 | 0 |
| JBT1535 | Ac-SRYPWF[CGMRDMKGTMSC]VWVKF-NH2 (SEQ ID NO: 1278) | | | 0 | 1 |
| JBT1536 | Ac-SRYKPF[CGMRDMKGTMSC]VWVKF-NH2 (SEQ ID NO: 1279) | | | 0 | 0 |
| JBT1537 | Ac-SRYKWP[CGMRDMKGTMSC]VWVKF-NH2 (SEQ ID NO: 1280) | | | 0 | 0 |
| JBT1538 | Ac-SRYKWF[CGMRDMKGTMSC]PWVKF-NH2 (SEQ ID NO: 1281) | | | 2 | 2 |
| JBT1539 | Ac-SRYKWF[CGMRDMKGTMSC]VPVKF-NH2 (SEQ ID NO: 1282) | | | 0 | 0 |
| JBT1540 | Ac-SRYKWF[CGMRDMKGTMSC]VWPKF-NH2 (SEQ ID NO: 1283) | | | 0 | 0 |
| JBT1541 | Ac-SRYKWF[CGMRDMKGTMSC]VWVPF-NH2 (SEQ ID NO: 1023) | 0.47 | 89 | 69 | 49 |
| JBT1542 | Ac-SRYKWF[CGMRDMKGTMSC]VWVKP-NH2 (SEQ ID NO: 1188) | | | 15 | 3 |
| JBT1543 | Ac-SRYKWF[CGMRDMKGTMSC]VWVKF-OH (SEQ ID NO: 1098) | | | 44 | 20 |
| JBT1544 | H-SRYKWF[CGMRDMKGTMSC]VWVKF-NH2 (SEQ ID NO: 1024) | 0.64 | 88 | 67 | 44 |
| JBT1545 | H-SRYKWF[CGMRDMKGTMSC]VWVKF-OH (SEQ ID NO: 1099) | | | 40 | 20 |
| JBT1546 | Ac-SRYKWF[CEMRDMKGTMSC]VWVKF-NH2 (SEQ ID NO: 1284) | | | 3 | 2 |
| JBT1547 | Ac-SRYKWF[CHMRDMKGTMSC]VWVKF-NH2 (SEQ ID NO: 1285) | | | 2 | 0 |
| JBT1548 | Ac-SRYKWF[CIMRDMKGTMSC]VWVKF-NH2 (SEQ ID NO: 1286) | | | 6 | 3 |
| JBT1549 | Ac-SRYKWF[CMMRDMKGTMSC]VWVKF-NH2 (SEQ ID NO: 1189) | | | 9 | 3 |
| JBT1550 | Ac-SRYKWF[CNMRDMKGTMSC]VWVKF-NH2 (SEQ ID NO: 1190) | | | 20 | 10 |
| JBT1551 | Ac-SRYKWF[CQMRDMKGTMSC]VWVKF-NH2 (SEQ ID NO: 1146) | | | 31 | 13 |
| JBT1552 | Ac-SRYKWF[CRMRDMKGTMSC]VWVKF-NH2 (SEQ ID NO: 1147) | | | 32 | 12 |
| JBT1553 | Ac-SRYKWF[CTMRDMKGTMSC]VWVKF-NH2 (SEQ ID NO: 1148) | | | 36 | 15 |
| JBT1554 | Ac-SRYKWF[CVMRDMKGTMSC]VWVKF-NH2 (SEQ ID NO: 1287) | | | 6 | 2 |

FIG. 23K

| JBT0120 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT1555 | Ac-SRYKWF[CWMRDMKGTMSC]VWVKF-NH2 (SEQ ID NO: 1191) | | | 8 | 2 |
| JBT1556 | Ac-SRYKWF[CYMRDMKGTMSC]VWVKF-NH2 (SEQ ID NO: 1288) | | | 5 | 0 |
| JBT1557 | H-RYKWF[CGMRDMKGTMSC]VWVKF-NH2 (SEQ ID NO: 173) | | | 53 | 27 |
| JBT1558 | H-YKWF[CGMRDMKGTMSC]VWVKF-NH2 (SEQ ID NO: 1149) | | | 17 | 3 |
| JBT1559 | Ac-SRYKWF[CGaRDMKGTMSC]VWVKF-NH2 (SEQ ID NO: 1150) | | | 29 | 10 |
| JBT1560 | Ac-SRYKWF[CGdRDMKGTMSC]VWVKF-NH2 (SEQ ID NO: 1289) | | | 1 | 1 |
| JBT1561 | Ac-SRYKWF[CGfRDMKGTMSC]VWVKF-NH2 (SEQ ID NO: 1192) | | | 9 | 1 |
| JBT1562 | Ac-SRYKWF[CGkRDMKGTMSC]VWVKF-NH2 (SEQ ID NO: 1193) | | | 5 | 1 |
| JBT1563 | Ac-SRYKWF[CGiRDMKGTMSC]VWVKF-NH2 (SEQ ID NO: 1194) | | | 14 | 6 |
| JBT1564 | Ac-SRYKWF[CGpRDMKGTMSC]VWVKF-NH2 (SEQ ID NO: 1100) | | | 65 | 40 |
| JBT1565 | Ac-SRYKWF[CGsRDMKGTMSC]VWVKF-NH2 (SEQ ID NO: 1195) | | | 13 | 3 |
| JBT1566 | Ac-SRYKWF[CGMRDaKGTMSC]VWVKF-NH2 (SEQ ID NO: 1151) | | | 33 | 13 |
| JBT1567 | Ac-SRYKWF[CGMRDdKGTMSC]VWVKF-NH2 (SEQ ID NO: 1101) | | | 45 | 21 |
| JBT1568 | Ac-SRYKWF[CGMRDfKGTMSC]VWVKF-NH2 (SEQ ID NO: 1074) | | | 63 | 38 |
| JBT1569 | Ac-SRYKWF[CGMRDkKGTMSC]VWVKF-NH2 (SEQ ID NO: 1102) | | | 50 | 23 |
| JBT1570 | Ac-SRYKWF[CGMRDiKGTMSC]VWVKF-NH2 (SEQ ID NO: 1025) | 0.74 | 88 | 62 | 43 |
| JBT1571 | Ac-SRYKWF[CGMRDpKGTMSC]VWVKF-NH2 (SEQ ID NO: 1196) | | | 15 | 5 |
| JBT1572 | Ac-SRYKWF[CGMRDsKGTMSC]VWVKF-NH2 (SEQ ID NO: 1152) | | | 28 | 9 |
| JBT1573 | Ac-SRYKWF[CGMRDMaGTMSC]VWVKF-NH2 (SEQ ID NO: 1197) | | | 20 | 4 |
| JBT1574 | Ac-SRYKWF[CGMRDMdGTMSC]VWVKF-NH2 (SEQ ID NO: 1153) | | | 39 | 15 |
| JBT1575 | Ac-SRYKWF[CGMRDMfGTMSC]VWVKF-NH2 (SEQ ID NO: 1198) | | | 18 | 3 |
| JBT1576 | Ac-SRYKWF[CGMRDMiGTMSC]VWVKF-NH2 (SEQ ID NO: 1199) | | | 19 | 6 |
| JBT1577 | Ac-SRYKWF[CGMRDMpGTMSC]VWVKF-NH2 (SEQ ID NO: 1200) | | | 14 | 2 |
| JBT1578 | Ac-SRYKWF[CGMRDMsGTMSC]VWVKF-NH2 (SEQ ID NO: 1154) | | | 30 | 10 |

FIG. 24A

| JBT0122 class | | FXa Inhibition assay | | | |
|---|---|---|---|---|---|
| Peptide | Sequence | EC50 (µM) | Maximal inhibition (%) | % Inhibition @ 2.5µM | % Inhibition @ 0.63µM |
| JBT0122 | AC-SGYASFPLAVQLHVSKRSKEMALARLYYKTS-NH2 (SEQ ID NO: 2002) | 7.92 | | 23 | |
| JBT0126 | Biotin-Ttds-SGYASFPLAVQLHVSKRSKEMALARLYYKTS-NH2 (SEQ ID NO: 2498) | 14.10 | | 17 | |
| JBT0221 | Ac-KKSGYASFPLAVQLHVSKRSKEMALARLYYKTSKK-NH2 (SEQ ID NO: 2003) | | | 29 | |
| JBT0222* | Ac-MKSRSLGLAYFAKHSSLEVLQTRKVAAPYY-NH2 (SEQ ID NO: 2127) | | | 0 | |
| JBT0223* | Ac-KMQLRVYASTAHSRYLLGSSLFPKYAEVKA-NH2 (SEQ ID NO: 2297) | | | 0 | |
| JBT0224 | Ac-KKSGYASFPLAVQLHVSKRSKEMALARLYYKK-NH2 (SEQ ID NO: 2298) | | | 26 | |
| JBT0225 | Ac-KKSGYASFPLAVQLHVSKRSKEMALARKK-NH2 (SEQ ID NO: 2128) | | | 12 | |
| JBT0226 | Ac-KKSGYASFPLAVQLHVSKRSKEMAKK-NH2 (SEQ ID NO: 2299) | | | 6 | |
| JBT0227 | Ac-KKSGYASFPLAVQLHVSKRSKKK-NH2 (SEQ ID NO: 2300) | | | 0 | |
| JBT0228 | Ac-KKASFPLAVQLHVSKRSKEMALARLYYKTSKK-NH2 (SEQ ID NO: 2016) | | | 21 | |
| JBT0229 | Ac-KKPLAVQLHVSKRSKEMALARLYYKTSKK-NH2 (SEQ ID NO: 2129) | | | 0 | |
| JBT0230 | Ac-KKVQLHVSKRSKEMALARLYYKTSKK-NH2 (SEQ ID NO: 2301) | | | 0 | |
| JBT0231 | Ac-KKHVSKRSKEMALARLYYKTSKK-NH2 (SEQ ID NO: 2302) | | | 0 | |
| JBT0232 | Ac-KKGYASFPLAVQLHVSKRSKEMKK-NH2 (SEQ ID NO: 2303) | | | 6 | |
| JBT0233 | Ac-KKYASFPLAVQLHVSKRSKEMAKK-NH2 (SEQ ID NO: 2304) | | | 8 | |
| JBT0234 | Ac-KKVQLHVSKRSKEMALARLYYKKK-NH2 (SEQ ID NO: 2305) | | | 0 | |
| JBT0235 | Ac-KKQLHVSKRSKEMALARLYYKTKK-NH2 (SEQ ID NO: 2306) | | | 0 | |
| JBT0236 | Ac-KKLHVSKRSKEMALARLYYKTSKK-NH2 (SEQ ID NO: 2307) | | | 0 | |
| JBT0237 | Ac-KKSGYASFPLAVQLHVSKRSKEKK-NH2 (SEQ ID NO: 2308) | | | 0 | |
| JBT0359 | Ac-ASFPLAVQLHVSKRSKEMA-NH2 (SEQ ID NO: 2309) | | | 0 | |
| JBT0360 | Ac-SFPLAVQLHVSKRSKEMA-NH2 (SEQ ID NO: 2310) | | | 1 | |

FIG. 24B

| JBT0122 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT0361 | Ac-FPLAVQLHVSKRSKEMA-NH2 (SEQ ID NO: 2311) | | | 0 | |
| JBT0362 | Ac-ASFPLAVQLHVSKRSKEM-NH2 (SEQ ID NO: 2312) | | | 0 | |
| JBT0363 | Ac-ASFPLAVQLHVSKRSKE-NH2 (SEQ ID NO: 2313) | | | 0 | |
| JBT0364 | Ac-ASFPLAVQLHVSKRSKEMAL-NH2 (SEQ ID NO: 2314) | | | 2 | |
| JBT0365 | Ac-ASFPLAVQLHVSKRSKEMALA-NH2 (SEQ ID NO: 2315) | | | 0 | |
| JBT0366 | Ac-ASFPLAVQLHVSKRSKEMALAR-NH2 (SEQ ID NO: 2316) | | | 0 | |
| JBT0367 | Ac-ASFPLAVQLHVSKRSKEMALARL-NH2 (SEQ ID NO: 2317) | | | 2 | |
| JBT0368 | Ac-ASFPLAVQLHVSKRSKEMALARLY-NH2 (SEQ ID NO: 2130) | | | 0 | |
| JBT0369 | Ac-ASFPLAVQLHVSKRSKEMALARLYY-NH2 (SEQ ID NO: 2017) | | | 2 | |
| JBT0370 | Ac-YASFPLAVQLHVSKRSKEMA-NH2 (SEQ ID NO: 2318) | | | 2 | |
| JBT0371 | Ac-GYASFPLAVQLHVSKRSKEMA-NH2 (SEQ ID NO: 2319) | | | 8 | |
| JBT0660 | Ac-AGYASFPLAVQLHVSKRSKEMALARLYYKTS-NH2 (SEQ ID NO: 2004) | | | 5 | 2 |
| JBT0661 | Ac-SAYASFPLAVQLHVSKRSKEMALARLYYKTS-NH2 (SEQ ID NO: 2005) | | | 13 | 5 |
| JBT0662 | Ac-SGAASFPLAVQLHVSKRSKEMALARLYYKTS-NH2 (SEQ ID NO: 2131) | | | 4 | 0 |
| JBT0664 | Ac-SGYAAFPLAVQLHVSKRSKEMALARLYYKTS-NH2 (SEQ ID NO: 2006) | | | 7 | 2 |
| JBT0665 | Ac-SGYASAPLAVQLHVSKRSKEMALARLYYKTS-NH2 (SEQ ID NO: 2132) | | | 2 | 0 |
| JBT0666 | Ac-SGYASFALAVQLHVSKRSKEMALARLYYKTS-NH2 (SEQ ID NO: 2001) | | | 12 | 6 |
| JBT0667 | Ac-SGYASFPAAVQLHVSKRSKEMALARLYYKTS-NH2 (SEQ ID NO: 2018) | | | 2 | 0 |
| JBT0669 | Ac-SGYASFPLAAQLHVSKRSKEMALARLYYKTS-NH2 (SEQ ID NO: 2133) | | | 0 | 0 |
| JBT0670 | Ac-SGYASFPLAVALHVSKRSKEMALARLYYKTS-NH2 (SEQ ID NO: 2007) | | | 6 | 0 |
| JBT0671 | Ac-SGYASFPLAVQAHVSKRSKEMALARLYYKTS-NH2 (SEQ ID NO: 2019) | | | 4 | 1 |
| JBT0672 | Ac-SGYASFPLAVQLASKRSKEMALARLYYKTS-NH2 (SEQ ID NO: 2134) | | | 2 | 0 |
| JBT0673 | Ac-SGYASFPLAVQLHASKRSKEMALARLYYKTS-NH2 (SEQ ID NO: 2135) | | | 0 | 0 |
| JBT0674 | Ac-SGYASFPLAVQLHVAKRSKEMALARLYYKTS-NH2 (SEQ ID NO: 2008) | | | 10 | 3 |
| JBT0675 | Ac-SGYASFPLAVQLHVSARSKEMALARLYYKTS-NH2 (SEQ ID NO: 2136) | | | 0 | 0 |

FIG. 24C

| JBT0122 class | | FXa Inhibition assay | | | |
|---|---|---|---|---|---|
| Peptide | Sequence | EC50 (μM) | Maximal inhibition (%) | % Inhibition @ 2.5μM | % Inhibition @ 0.63μM |
| JBT0676 | Ac-SGYASFPLAVQLHVSKASKEMALARLYYKTS-NH2 (SEQ ID NO: 2137) | | | 0 | 0 |
| JBT0677 | Ac-SGYASFPLAVQLHVSKRAKEMALARLYYKTS-NH2 (SEQ ID NO: 2009) | | | 4 | 0 |
| JBT0678 | Ac-SGYASFPLAVQLHVSKRSAEMALARLYYKTS-NH2 (SEQ ID NO: 2010) | | | 6 | 2 |
| JBT0679 | Ac-SGYASFPLAVQLHVSKRSKAMALARLYYKTS-NH2 (SEQ ID NO: 2020) | | | 2 | 0 |
| JBT0680 | Ac-SGYASFPLAVQLHVSKRSKEAALARLYYKTS-NH2 (SEQ ID NO: 2138) | | | 0 | 0 |
| JBT0682 | Ac-SGYASFPLAVQLHVSKRSKEMAAARLYYKTS-NH2 (SEQ ID NO: 2139) | | | 2 | 0 |
| JBT0684 | Ac-SGYASFPLAVQLHVSKRSKEMALAALYYKTS-NH2 (SEQ ID NO: 2011) | | | 5 | 1 |
| JBT0685 | Ac-SGYASFPLAVQLHVSKRSKEMALARAYYKTS-NH2 (SEQ ID NO: 2021) | | | 4 | 0 |
| JBT0686 | Ac-SGYASFPLAVQLHVSKRSKEMALARLAYKTS-NH2 (SEQ ID NO: 2140) | | | 3 | 0 |
| JBT0687 | Ac-SGYASFPLAVQLHVSKRSKEMALARLYAKTS-NH2 (SEQ ID NO: 2141) | | | 3 | 0 |
| JBT0688 | Ac-SGYASFPLAVQLHVSKRSKEMALARLYYATS-NH2 (SEQ ID NO: 2012) | | | 8 | 2 |
| JBT0689 | Ac-SGYASFPLAVQLHVSKRSKEMALARLYYKAS-NH2 (SEQ ID NO: 2013) | | | 10 | 3 |
| JBT0690 | Ac-SGYASFPLAVQLHVSKRSKEMALARLYYKTA-NH2 (SEQ ID NO: 2014) | | | 10 | 3 |
| JBT1579 | Ac-GYASFPLAVQLHVAKRSKEMA-NH2 (SEQ ID NO: 2015) | | | 9 | 4 |
| JBT1580 | Ac-GYASFALSVQLHVSKRSKEMA-NH2 (SEQ ID NO: 2320) | | | 3 | 1 |
| JBT1581 | Ac-GYASFALAVQLHVAKRSKEMA-NH2 (SEQ ID NO: 2321) | | | 11 | 4 |
| JBT1582 | Ac-GYASFPLAVQLHVMKRSKEMA-NH2 (SEQ ID NO: 2022) | | | 10 | 3 |
| JBT1583 | Ac-GYASFALAVQLHVMKRSKEMA-NH2 (SEQ ID NO: 2322) | | | 18 | 5 |
| JBT1599 | Ac-FPLAVQLHVSKRSKEMALA-NH2 (SEQ ID NO: 2323) | | | 0 | 0 |
| JBT1600 | Ac-QLHVSKRSKEMALA-NH2 (SEQ ID NO: 2324) | | | 0 | 0 |
| JBT1601 | Ac-SGYASFP-NH2 (SEQ ID NO: 2325) | | | 0 | 0 |
| JBT1602 | Ac-LAVQLHVSKRSKEMALARL-NH2 (SEQ ID NO: 2326) | | | 0 | 0 |

FIG. 25A

| JBT0047 class | | Extrinsic Tenase Inhibition assay | |
|---|---|---|---|
| Peptide | Sequence | EC50 (µM) | % Inhibition @ 2.5µM |
| JBT0047 | Ac-SGVGRLQVAFQSKKNVFVFGYFERLRAKLTS-NH2 (SEQ ID NO: 253) | 1.37 | 20 |
| JBT0051 | Biotin-Ttds-SGVGRLQVAFQSKKNVFVFGYFERLRAKLTS-NH2 (SEQ ID NO: 962) | 1.04 | 19 |
| JBT0055 | Ac-SGVGRLQVAFQSKKNVFVFGYFERLRAKLTS-Ttds-Lysin(biotin)-NH2 (SEQ ID NO: 963) | 1.67 | 25 |
| JBT0131 | Biotin-Ttds-AFQSKKNVFVFGYFERLRAK-NH2 (SEQ ID NO: 964) | 2.02 | 11 |
| JBT0132 | Biotin-Ttds-FQSKKNVFVFGYFERLRAKL-NH2 (SEQ ID NO: 965) | | 11 |
| JBT0133 | Biotin-Ttds-QSKKNVFVFGYFERLRAKLT-NH2 (SEQ ID NO: 966) | | 9 |
| JBT0134 | Biotin-Ttds-QSKKNVFVFGYFERLRAK-NH2 (SEQ ID NO: 967) | | 3 |
| JBT0155 | Ac-KKSGVGRLQVAFQSKKNVFVFGYFERLRAKLTSKK-NH2 (SEQ ID NO: 8) | 0.38 | 33 |
| JBT0158 | Ac-KKSGVGRLQVAFQSKKNVFVFGYFERLRAKKK-NH2 (SEQ ID NO: 9) | | 23 |
| JBT0159 | Ac-KKSGVGRLQVAFQSKKNVFVFGYFERLKK-NH2 (SEQ ID NO: 744) | | 18 |
| JBT0160 | Ac-KKSGVGRLQVAFQSKKNVFVFGYFKK-NH2 (SEQ ID NO: 745) | | 22 |
| JBT0161 | Ac-KKSGVGRLQVAFQSKKNVFVFKK-NH2 (SEQ ID NO: 746) | | 6 |
| JBT0162 | Ac-KKGRLQVAFQSKKNVFVFGYFERLRAKLTSKK-NH2 (SEQ ID NO: 10) | 0.28 | 34 |
| JBT0163 | Ac-KKQVAFQSKKNVFVFGYFERLRAKLTSKK-NH2 (SEQ ID NO: 11) | 0.89 | 31 |
| JBT0164 | Ac-KKFQSKKNVFVFGYFERLRAKLTSKK-NH2 (SEQ ID NO: 12) | 2.68 | 24 |
| JBT0165 | Ac-KKKKNVFVFGYFERLRAKLTSKK-NH2 (SEQ ID NO: 712) | | 15 |
| JBT0166 | Biotinyl-Ttds-KKFQSKKNVFVFGYFERLRAKLKK-NH2 (SEQ ID NO: 968) | 1.95 | 36 |
| JBT0169 | Ac-KKAFQSKKNVFVFGYFERLRAKKK-NH2 (SEQ ID NO: 254) | 2.35 | 20 |
| JBT0170 | Ac-KKFQSKKNVFVFGYFERLRAKLKK-NH2 (SEQ ID NO: 13) | 1.90 | 30 |
| JBT0171 | Ac-KKQSKKNVFVFGYFERLRAKLTKK-NH2 (SEQ ID NO: 255) | 4.12 | 13 |

FIG. 25B

| JBT0047 class | | Extrinsic Tenase Inhibition assay | |
|---|---|---|---|
| Peptide | Sequence | EC50 (µM) | % Inhibition @ 2.5µM |
| JBT0172 | Ac-KKQSKKNVFVFGYFERLRAKKK-NH2 (SEQ ID NO: 406) | 3.98 | 8 |
| JBT0173 | Biotinyl-Ttds-SGVGRLQVAFQSKKKNVFVFG-NH2 (SEQ ID NO: 971) | | 3 |
| JBT0174 | Ac-KKAFQSKKNVFVFGYFERLRAKLKK-NH2 (SEQ ID NO: 14) | 2.90 | 26 |
| JBT0175 | Ac-KKAFQSKKNVFVFGYFERLRAKLTKK-NH2 (SEQ ID NO: 182) | 2.29 | 26 |
| JBT0293 | Ac-FQSKKNVFVFGYFERLRAKL-NH2 (SEQ ID NO: 256) | 1.62 | 16 |
| JBT0294 | Ac-YQSKKNVFVFGYFERLRAKL-NH2 (SEQ ID NO: 257) | 5.31 | 9 |
| JBT0295 | Ac-FSSKKNVFVFGYFERLRAKL-NH2 (SEQ ID NO: 713) | 1.80 | 10 |
| JBT0296 | Ac-FQNKKNVFVFGYFERLRAKL-NH2 (SEQ ID NO: 407) | 7.83 | 10 |
| JBT0297 | Ac-FQSKNNVFVFGYFERLRAKL-NH2 (SEQ ID NO: 183) | | 13 |
| JBT0298 | Ac-FQSKQNVFVFGYFERLRAKL-NH2 (SEQ ID NO: 747) | | 15 |
| JBT0299 | Ac-FQSKKNVFAFGYFERLRAKL-NH2 (SEQ ID NO: 408) | | 5 |
| JBT0300 | Ac-FQSKKNVFSFGYFERLRAKL-NH2 (SEQ ID NO: 409) | | 3 |
| JBT0301 | Ac-FQSKKNVFTFGYFERLRAKL-NH2 (SEQ ID NO: 410) | | 0 |
| JBT0302 | Ac-FQSKKNVFVAGYFERLRAKL-NH2 (SEQ ID NO: 258) | | 3 |
| JBT0303 | Ac-FQSKKNVFVDGYFERLRAKL-NH2 (SEQ ID NO: 184) | 8.80 | 9 |
| JBT0304 | Ac-FQSKKNVFVLGYFERLRAKL-NH2 (SEQ ID NO: 259) | | 7 |
| JBT0305 | Ac-FQSKKNVFVQGYFERLRAKL-NH2 (SEQ ID NO: 260) | | 0 |
| JBT0306 | Ac-FQSKKNVFVSGYFERLRAKL-NH2 (SEQ ID NO: 185) | | 3 |
| JBT0307 | Ac-FQSKKNVFVYGYFERLRAKL-NH2 (SEQ ID NO: 261) | | 4 |
| JBT0308 | Ac-FQSKKNVFVFGYKERLRAKL-NH2 (SEQ ID NO: 411) | 8.72 | 4 |
| JBT0309 | Ac-FQSKKNVFVFGYYERLRAKL-NH2 (SEQ ID NO: 412) | 8.55 | 7 |

FIG. 25C

JBT0047 class

| Peptide | Sequence | Extrinsic Tenase Inhibition assay | |
|---|---|---|---|
| | | EC50 (μM) | % Inhibition @ 2.5μM |
| JBT0310 | Ac-FQSKKNVFVFGYFDRLRAKL-NH2 (SEQ ID NO: 262) | | 5 |
| JBT0311 | Ac-FQSKKNVFVFGYFERLRAKN-NH2 (SEQ ID NO: 748) | 3.72 | 10 |
| JBT0335 | Ac-FQSKKNVFVFGYFERLRAK-NH2 (SEQ ID NO: 749) | 10.48 | 5 |
| JBT0336 | Ac-FQSKNNVFVAGYFDRLRAKL-OH (SEQ ID NO: 263) | 12.13 | 5 |
| JBT0337 | Ac-FQSKNNVFVDGYFDRLRAKL-NH2 (SEQ ID NO: 16) | 13.33 | 15 |
| JBT0338 | Ac-FQSKNNVFVQGYFDRLRAKL-NH2 (SEQ ID NO: 17) | 8.42 | 9 |
| JBT0339 | Ac-FQSKNNVFVSGYFDRLRAKL-NH2 (SEQ ID NO: 18) | | 9 |
| JBT0340 | Ac-FQSKNNVFVGYGYFDRLRAKL-NH2 (SEQ ID NO: 186) | | 9 |
| JBT0341 | Ac-FQSKNNVFVFGYFDRLRAKL-NH2 (SEQ ID NO: 187) | 8.68 | 10 |
| JBT0342 | Ac-FQSKNNVFVDGYFERLRAKL-NH2 (SEQ ID NO: 19) | 7.15 | 18 |
| JBT0343 | Ac-FQSKNNVFVDGYFDRLRAKL-NH2 (SEQ ID NO: 188) | | 8 |
| JBT0374 | Ac-FQSKDNVFVFGYFERLRAKL-NH2 (SEQ ID NO: 20) | | 19 |
| JBT0375 | Ac-FQSKGNVFVFGYFERLRAKL-NH2 (SEQ ID NO: 190) | 2.93 | 30 |
| JBT0376 | Ac-FQSKKNAFVFGYFERLRAKL-NH2 (SEQ ID NO: 414) | | 3 |
| JBT0377 | Ac-FQSKKNQFVFGYFERLRAKL-NH2 (SEQ ID NO: 264) | | 8 |
| JBT0378 | Ac-FQSKKNVFVEGYFERLRAKL-NH2 (SEQ ID NO: 21) | 9.03 | 12 |
| JBT0379 | Ac-FQSKKNVFVTGYFERLRAKL-NH2 (SEQ ID NO: 22) | | 6 |
| JBT0380 | Ac-FQSKKNVFVVGYFERLRAKL-NH2 (SEQ ID NO: 191) | 7.58 | 10 |
| JBT0381 | Ac-FQSPKNVFVFGYFERLRAKL-NH2 (SEQ ID NO: 265) | | 9 |
| JBT0385 | Ac-FQSKKNNFVFGYFERLRAKL-NH2 (SEQ ID NO: 672) | | 2 |
| JBT0386 | Ac-FQSKKNPFVFGYFERLRAKL-NH2 (SEQ ID NO: 415) | | 5 |

FIG. 25D

| JBT0047 class | | Extrinsic Tenase Inhibition assay | |
|---|---|---|---|
| Peptide | Sequence | EC50 (µM) | % Inhibition @ 2.5µM |
| JBT0388 | Ac-FQSKKNVHVFGYFERLRAKL-NH2 (SEQ ID NO: 192) | | 6 |
| JBT0389 | Ac-FQSKKNVVVFGYFERLRAKL-NH2 (SEQ ID NO: 673) | | 8 |
| JBT0390 | Ac-FQSKKNVFQFGYFERLRAKL-NH2 (SEQ ID NO: 674) | | 5 |
| JBT0391 | Ac-FQSKKNVFVGGYFERLRAKL-NH2 (SEQ ID NO: 266) | | 1 |
| JBT0392 | Ac-FQSKKNVFVHGYFERLRAKL-NH2 (SEQ ID NO: 23) | | 4 |
| JBT0393 | Ac-FQSKKNVFVKGYFERLRAKL-NH2 (SEQ ID NO: 193) | | 3 |
| JBT0394 | Ac-FQSKKNVFVMGYFERLRAKL-NH2 (SEQ ID NO: 24) | 4.38 | 8 |
| JBT0395 | Ac-FQSKKNVFVNGYFERLRAKL-NH2 (SEQ ID NO: 25) | | 7 |
| JBT0396 | Ac-FQSKKNVFVPGYFERLRAKL-NH2 (SEQ ID NO: 194) | 8.71 | 6 |
| JBT0397 | Ac-FQSKKNVFVRGYFERLRAKL-NH2 (SEQ ID NO: 195) | | 4 |
| JBT0398 | Ac-FQSKKNVFVFGYFEELRAKL-NH2 (SEQ ID NO: 196) | | 8 |
| JBT0399 | Ac-FQSKKNVFVFGYFELLRAKL-NH2 (SEQ ID NO: 750) | | 7 |
| JBT0400 | Ac-FQSKKNVFVFGYFLRLRAKL-NH2 (SEQ ID NO: 267) | | 13 |
| JBT0401 | Ac-FQSKKNVFVFGYFERLRAVL-NH2 (SEQ ID NO: 416) | | 4 |
| JBT0402 | Biotin-Ttds-FQSKNNVFVFGYFERLRAKL-NH2 (SEQ ID NO: 973) | | 11 |
| JBT0403 | Biotin-Ttds-FQSKKNVFVDGYFERLRAKL-NH2 (SEQ ID NO: 972) | | 9 |
| JBT0404 | Biotin-Ttds-FQSKKNVFVFGYFDRLRAKL-NH2 (SEQ ID NO: 974) | 3.38 | 14 |
| JBT0405 | Biotin-FQSKKNVFVFGYFERLRAKL-NH2 (SEQ ID NO: 975) | | 15 |
| JBT0406 | Ac-Ttds-FQSKKNVFVFGYFERLRAKL-NH2 (SEQ ID NO: 268) | | 9 |
| JBT0471 | Ac-FQSKGNVFVTGYFERLRAKL-NH2 (SEQ ID NO: 26) | | 32 |
| JBT0472 | Ac-FQSKGNVFVNGYFERLRAKL-NH2 (SEQ ID NO: 27) | | 22 |

FIG. 25E

| JBT0047 class | | Extrinsic Tenase Inhibition assay | |
|---|---|---|---|
| Peptide | Sequence | EC50 (µM) | % Inhibition @ 2.5µM |
| JBT0473 | Ac-FQSKGNVFVHGYFERLRAKL-NH2 (SEQ ID NO: 28) | | 24 |
| JBT0474 | Ac-FQSKGNVFVKGYFERLRAKL-NH2 (SEQ ID NO: 29) | | 33 |
| JBT0475 | Ac-FQSKGNVFVEGYFERLRAKL-NH2 (SEQ ID NO: 30) | | 30 |
| JBT0476 | Ac-FQSKGNVFVDGYFDRLRAKL-NH2 (SEQ ID NO: 31) | | 33 |
| JBT0477 | Ac-FQSKGNVFVDGYFERLRAKL-NH2 (SEQ ID NO: 32) | 2.22 | 36 |
| JBT0478 | Ac-FQSKDNVFVTGYFERLRAKL-NH2 (SEQ ID NO: 33) | | 19 |
| JBT0479 | Ac-FQSKDNVFVNGYFERLRAKL-NH2 (SEQ ID NO: 34) | | 18 |
| JBT0480 | Ac-FQSKDNVFVHGYFERLRAKL-NH2 (SEQ ID NO: 35) | | 16 |
| JBT0481 | Ac-FQSKDNVFVKGYFERLRAKL-NH2 (SEQ ID NO: 36) | | 15 |
| JBT0482 | Ac-FQSKDNVFVEGYFERLRAKL-NH2 (SEQ ID NO: 37) | | 23 |
| JBT0483 | Ac-FQSKDNVFVDGYFERLRAKL-NH2 (SEQ ID NO: 38) | | 24 |
| JBT0484 | Ac-FQSKDNVFVDGYFDRLRAKL-NH2 (SEQ ID NO: 976) | 4.89 | 19 |
| JBT0485 | Ac-FQSKNNVFVTGYFERLRAKL-NH2 (SEQ ID NO: 39) | | 21 |
| JBT0486 | Ac-FQSKNNVFVNGYFERLRAKL-NH2 (SEQ ID NO: 40) | | 19 |
| JBT0487 | Ac-FQSKNNVFVHGYFERLRAKL-NH2 (SEQ ID NO: 41) | | 19 |
| JBT0488 | Ac-FQSKNNVFVKGYFERLRAKL-NH2 (SEQ ID NO: 42) | | 19 |
| JBT0489 | Ac-FQSKNNVFVEGYFERLRAKL-NH2 (SEQ ID NO: 43) | | 18 |
| JBT0490 | Ac-FQSKQNVFVTGYFERLRAKL-NH2 (SEQ ID NO: 44) | | 21 |
| JBT0491 | Ac-FQSKQNVFVNGYFERLRAKL-NH2 (SEQ ID NO: 197) | | 9 |
| JBT0492 | Ac-FQSKQNVFVHGYFERLRAKL-NH2 (SEQ ID NO: 198) | | 10 |
| JBT0493 | Ac-FQSKQNVFVKGYFERLRAKL-NH2 (SEQ ID NO: 199) | | 7 |

FIG. 25F

| JBT0047 class | | Extrinsic Tenase Inhibition assay | |
|---|---|---|---|
| Peptide | Sequence | EC50 (µM) | % Inhibition @ 2.5µM |
| JBT0494 | Ac-FQSKQNVFVDGYFERLRAKL-NH2 (SEQ ID NO: 45) | | 15 |
| JBT0495 | Ac-FQSKQNVFVEGYFERLRAKL-NH2 (SEQ ID NO: 200) | | 15 |
| JBT0497 | Ac-NmetPhe-QSKGNVFVFGYFERLRAKL-NH2 (SEQ ID NO: 201) | 1.13 | 15 |
| JBT0498 | Ac-FQ-NmetSer-KGNVFVFGYFERLRAKL-NH2 (SEQ ID NO: 675) | | 9 |
| JBT0499 | Ac-FQS-NmetLys-GNVFVFGYFERLRAKL-NH2 (SEQ ID NO: 202) | | 11 |
| JBT0500 | Ac-FQSK-NmetGly-NVFVFGYFERLRAKL-NH2 (SEQ ID NO: 46) | 1.11 | 45 |
| JBT0501 | Ac-FQSKG-NmetV-FVFGYFERLRAKL-NH2 (SEQ ID NO: 417) | | 0 |
| JBT0502 | Ac-FQSKGN-NmetPhe-VFGYFERLRAKL-NH2 (SEQ ID NO: 751) | | 1 |
| JBT0503 | Ac-FQSKGNV-NmetV-FGYFERLRAKL-NH2 (SEQ ID NO: 676) | | 0 |
| JBT0504 | Ac-FQSKGNVF-NmetPhe-GYFERLRAKL-NH2 (SEQ ID NO: 418) | | 5 |
| JBT0505 | Ac-FQSKGNVFV-NmetGly-YFERLRAKL-NH2 (SEQ ID NO: 269) | | 9 |
| JBT0506 | Ac-FQSKGNVFVFG-NmetTyr-FERLRAKL-NH2 (SEQ ID NO: 714) | | 0 |
| JBT0507 | Ac-FQSKGNVFVFGY-NmetPhe-ERLRAKL-NH2 (SEQ ID NO: 677) | | 0 |
| JBT0508 | Ac-FQSKGNVFVFGYF-NmetGlu-RLRAKL-NH2 (SEQ ID NO: 678) | | 2 |
| JBT0509 | Ac-FQSKGNVFVFGYFE-Nmr-LRAKL-NH2 (SEQ ID NO: 752) | | 2 |
| JBT0510 | Ac-FQSKGNVFVFGYFER-NmetLeu-RAKL-NH2 (SEQ ID NO: 753) | | 3 |
| JBT0511 | Ac-FQSKGNVFVFGYFERL-Nmr-AKL-NH2 (SEQ ID NO: 754) | | 7 |
| JBT0512 | Ac-FQSKGNVFVFGYFERLR-NmetAla-KL-NH2 (SEQ ID NO: 679) | | 1 |
| JBT0513 | Ac-FQSKGNVFVFGYFERLRA-NmetLys-L-NH2 (SEQ ID NO: 755) | | 3 |
| JBT0514 | Ac-FQSKGNVFVFGYFERLRAK-NmetLeu-NH2 (SEQ ID NO: 419) | | 5 |
| JBT0515 | Ac-bHomoPhe-QSKGNVFVFGYFERLRAKL-NH2 (SEQ ID NO: 420) | | 0 |

FIG. 25G

| JBT0047 class | | Extrinsic Tenase Inhibition assay | |
|---|---|---|---|
| Peptide | Sequence | EC50 (µM) | % Inhibition @ 2.5µM |
| JBT0516 | Ac-F-bHomoGln-SKGNVFVFGYFERLRAKL-NH2 (SEQ ID NO: 680) | | 0 |
| JBT0517 | Ac-FQ-bHomoSer-KGNVFVFGYFERLRAKL-NH2 (SEQ ID NO: 421) | | 0 |
| JBT0518 | Ac-FQS-bHomoLys-GNVFVFGYFERLRAKL-NH2 (SEQ ID NO: 422) | | 0 |
| JBT0519 | Ac-FQSK-bAla-NVFVFGYFERLRAKL-NH2 (SEQ ID NO: 270) | | 0 |
| JBT0520 | Ac-FQSKG-bGln-VFVFGYFERLRAKL-NH2 (SEQ ID NO: 271) | | 0 |
| JBT0521 | Ac-FQSKGN-bLeu-FVFGYFERLRAKL-NH2 (SEQ ID NO: 756) | | 0 |
| JBT0522 | Ac-FQSKGNV-bHomoPhe-VFGYFERLRAKL-NH2 (SEQ ID NO: 681) | | 0 |
| JBT0523 | Ac-FQSKGNVF-bLeu-FGYFERLRAKL-NH2 (SEQ ID NO: 757) | | 0 |
| JBT0524 | Ac-FQSKGNVFV-bHomoPhe-GYFERLRAKL-NH2 (SEQ ID NO: 682) | | 0 |
| JBT0525 | Ac-FQSKGNVFVF-bAla-YFERLRAKL-NH2 (SEQ ID NO: 758) | | 0 |
| JBT0526 | Ac-FQSKGNVFVFG-bHomoTyr-FERLRAKL-NH2 (SEQ ID NO: 759) | | 0 |
| JBT0527 | Ac-FQSKGNVFVFGY-bHomoPhe-ERLRAKL-NH2 (SEQ ID NO: 683) | | 0 |
| JBT0528 | Ac-FQSKGNVFVFGYF-bE-RLRAKL-NH2 (SEQ ID NO: 272) | | 8 |
| JBT0529 | Ac-FQSKGNVFVFGYFE-bHomoArg-LRAKL-NH2 (SEQ ID NO: 760) | | 0 |
| JBT0530 | Ac-FQSKGNVFVFGYFER-Btl-RAKL-NH2 (SEQ ID NO: 684) | | 0 |
| JBT0531 | Ac-FQSKGNVFVFGYFERL-bHomoArg-AKL-NH2 (SEQ ID NO: 203) | | 0 |
| JBT0532 | Ac-FQSKGNVFVFGYFERLR-bAla-KL-NH2 (SEQ ID NO: 423) | | 0 |
| JBT0533 | Ac-FQSKGNVFVFGYFERLRA-bHomoK-L-NH2 (SEQ ID NO: 424) | | 0 |
| JBT0534 | Ac-FQSKGNVFVFGYFERLRAK-Btl-NH2 (SEQ ID NO: 204) | | 8 |
| JBT0535 | Ac-FQSKGNVFVFGYFE-Cit-LRAKL-NH2 (SEQ ID NO: 685) | | 1 |
| JBT0536 | Ac-FQSKGNVFVFGYFERL-Cit-AKL-NH2 (SEQ ID NO: 273) | | 11 |

FIG. 25H

| JBT0047 class | | Extrinsic Tenase Inhibition assay | |
|---|---|---|---|
| Peptide | Sequence | EC50 (µM) | % Inhibition @ 2.5µM |
| JBT0537 | Ac-FQSKGNVFVFGYFE-Nle-LRAKL-NH2 (SEQ ID NO: 761) | | 7 |
| JBT0538 | Ac-FQSKGNVFVFGYFERL-Nle-AKL-NH2 (SEQ ID NO: 425) | | 15 |
| JBT0564 | Ac-FQSKKNVFVFGYFKRLRAKL-NH2 (SEQ ID NO: 205) | | 0 |
| JBT0578 | Ac-FQSKKNVFVFGYFFRLRAKL-NH2 (SEQ ID NO: 441) | | 0 |
| JBT0613 | Ac-FQSKGNVFVFGYFERLRAKL-OH (SEQ ID NO: 283) | | 6 |
| JBT0614 | NH2-FQSKGNVFVFGYFERLRAKL-OH (SEQ ID NO: 720) | | 4 |
| JBT0615 | NH2-FQSKGNVFVFGYFERLRAKL-NH2 (SEQ ID NO: 284) | | 6 |
| JBT0651 | Ac-FQSKGNVHVKGYFERLRAKL-NH2 (SEQ ID NO: 48) | | 6 |
| JBT0652 | Ac-FQSKGNVHVDGYFERLRAKL-NH2 (SEQ ID NO: 49) | | 8 |
| JBT0653 | Ac-FQSPGNVHVKGYFERLRAKL-NH2 (SEQ ID NO: 50) | | 9 |
| JBT0654 | Ac-FQSPGNVHVDGYFERLRAKL-NH2 (SEQ ID NO: 51) | | 11 |
| JBT0655 | Ac-FQSKGNIFVFGYFERLRAKL-NH2 (SEQ ID NO: 52) | | 9 |
| JBT0656 | Ac-FQSKGNLFVFGYFERLRAKL-NH2 (SEQ ID NO: 286) | | 5 |
| JBT0657 | Ac-FQSKGNVFIFGYFERLRAKL-NH2 (SEQ ID NO: 287) | | 8 |
| JBT0658 | Ac-FQSKGNVFLFGYFERLRAKL-NH2 (SEQ ID NO: 694) | | 3 |
| JBT0663 | Ac-FQSKaNVFVFGYFERLRAKL-NH2 (SEQ ID NO: 53) | | 22 |
| JBT0668 | Ac-FQSKaNVFVTGYFARLRAKL-NH2 (SEQ ID NO: 54) | | 16 |
| JBT0681 | Ac-FQSK-Nmg-AVFVFGYFARLRAKL-NH2 (SEQ ID NO: 206) | | 25 |
| JBT0683 | Ac-FQSK-Nmg-AVFVDGYFARLRAKL-NH2 (SEQ ID NO: 55) | | 38 |
| JBT0708 | Ac-FQSKaNVFVAGYFERLRAKL-NH2 (SEQ ID NO: 59) | | 25 |
| JBT0714 | Ac-FQSKaAVFVDGYFARLRAKL-NH2 (SEQ ID NO: 60) | | 29 |

FIG. 25I

| JBT0047 class | | Extrinsic Tenase Inhibition assay | |
|---|---|---|---|
| Peptide | Sequence | EC50 (µM) | % Inhibition @ 2.5µM |
| JBT0717 | Ac-FQSK-Nmg-NVFVDGYFERLRAKL-NH2 (SEQ ID NO: 61) | | 50 |
| JBT0720 | Ac-FQSK-Nmg-NVFVTGYFARLRAKL-NH2 (SEQ ID NO: 62) | | 30 |
| JBT0740 | Ac-FQSKGNVFVDGYFERL-Aib-AKL-NH2 (SEQ ID NO: 66) | | 36 |
| JBT0754 | Ac-FQSK-Nmg-AVFVTGYFARLRAKL-NH2 (SEQ ID NO: 67) | | 27 |
| JBT0765 | Ac-FQSKGNVFVDGYFERL-Eew-AKL-NH2 (SEQ ID NO: 68) | | 37 |
| JBT0780 | Ac-FQSK-Nmg-NVFVFGYFARLRAKL-NH2 (SEQ ID NO: 70) | 1.92 | 35 |
| JBT0789 | Ac-FQSK-Nmg-NVFVDGYFERL-Nle-AKL-NH2 (SEQ ID NO: 71) | 0.79 | 51 |
| JBT0806 | Ac-FQSK-Nmg-NVFVAGYFARLRAKL-NH2 (SEQ ID NO: 74) | 2.42 | 38 |
| JBT0837 | Ac-FQSK-Nmg-NVFVTGYFERL-Nle-AKL-NH2 (SEQ ID NO: 213) | | 33 |
| JBT0844 | Ac-FQSKaNVFVDGYFERLRAKL-NH2 (SEQ ID NO: 300) | | 23 |
| JBT0850 | Ac-FQSKaAVFVAGYFARLRAKL-NH2 (SEQ ID NO: 302) | | 24 |
| JBT0854 | Ac-FQSKaAVFVAGYFARL-Nle-AKL-NH2 (SEQ ID NO: 490) | | 14 |
| JBT0870 | Ac-FQSKaAVFVTGYFARLRAKL-NH2 (SEQ ID NO: 214) | | 20 |
| JBT0886 | Ac-FQSKaNVFVDGYFARLRAKL-NH2 (SEQ ID NO: 215) | | 21 |
| JBT0919 | Ac-FQSKaNVFVTGYFERLRAKL-NH2 (SEQ ID NO: 79) | | 24 |
| JBT0931 | Ac-FQSKGNVFVDGYFERL-Eag-AKL-NH2 (SEQ ID NO: 82) | | 24 |
| JBT0946 | Ac-FQSKGNVFVDGYFERL-Dab-AKL-NH2 (SEQ ID NO: 85) | | 29 |
| JBT0950 | Ac-FQSKGNVFVFGYFARLRAKL-NH2 (SEQ ID NO: 217) | | 14 |
| JBT0973 | Ac-FQSKGNVFVDGYFERL-Cha-AKL-NH2 (SEQ ID NO: 92) | 1.21 | 32 |
| JBT1006 | Ac-FQSKGNVFVDGYFERL-Hle-AKL-NH2 (SEQ ID NO: 96) | 1.35 | 35 |
| JBT1035 | Ac-FQSK-Nmg-AVFVAGYFARL-Nle-AKL-NH2 (SEQ ID NO: 218) | | 25 |

FIG. 25J

| JBT0047 class | | Extrinsic Tenase Inhibition assay | |
|---|---|---|---|
| Peptide | Sequence | EC50 (μM) | % Inhibition @ 2.5μM |
| JBT1037 | Ac-FQSKGNVFVDGYFERL-Nle-AKL-NH2 (SEQ ID NO: 104) | | 30 |
| JBT1043 | Ac-FQSKaNVFVDGYFERL-Nle-AKL-NH2 (SEQ ID NO: 106) | | 27 |
| JBT1082 | Ac-FQSKaAVFVFGYFARLRAKL-NH2 (SEQ ID NO: 565) | | 16 |
| JBT1084 | Ac-FQSK-Nnng-AVFVAGYFARLRAKL-NH2 (SEQ ID NO: 109) | | 28 |
| JBT1122 | Ac-FQSK-Nnng-NVFVDGYFARL-Nle-AKL-NH2 (SEQ ID NO: 113) | 0.81 | 43 |
| JBT1133 | Ac-FQSKkAVFVDGYFARLRAKL-NH2(SEQ ID NO: 115) | | 31 |
| JBT1134 | Ac-FQSKGAVFVDGYFARLRAKL-NH2 (SEQ ID NO: 116) | | 28 |
| JBT1135 | Ac-FQSKDAVFVDGYFARLRAKL-NH2 (SEQ ID NO: 221) | | 22 |
| JBT1136 | Ac-FQSKdAVFVDGYFARLRAKL-NH2 (SEQ ID NO: 117) | | 36 |
| JBT1137 | Ac-FQSKkAVFVAGYFARLRAKL-NH2 (SEQ ID NO: 118) | | 23 |
| JBT1138 | Ac-FQSKGAVFVAGYFARLRAKL-NH2 (SEQ ID NO: 222) | | 19 |
| JBT1139 | Ac-FQSKDAVFVAGYFARLRAKL-NH2 (SEQ ID NO: 223) | | 16 |
| JBT1140 | Ac-FQSKdAVFVAGYFARLRAKL-NH2 (SEQ ID NO: 119) | | 29 |
| JBT1141 | Ac-FQSKkAVFVKGYFARLRAKL-NH2 (SEQ ID NO: 120) | | 13 |
| JBT1142 | Ac-FQSKGAVFVKGYFARLRAKL-NH2 (SEQ ID NO: 224) | | 11 |
| JBT1143 | Ac-FQSKDAVFVKGYFARLRAKL-NH2 (SEQ ID NO: 225) | | 6 |
| JBT1144 | Ac-FQSKdAVFVKGYFARLRAKL-NH2 (SEQ ID NO: 121) | | 15 |
| JBT1145 | Ac-FQSKkAVFVTGYFARLRAKL-NH2 (SEQ ID NO: 122) | | 13 |
| JBT1146 | Ac-FQSKGAVFVTGYFARLRAKL-NH2 (SEQ ID NO: 226) | | 12 |
| JBT1147 | Ac-FQSKDAVFVTGYFARLRAKL-NH2 (SEQ ID NO: 227) | | 14 |
| JBT1148 | Ac-FQSKdAVFVTGYFARLRAKL-NH2 (SEQ ID NO: 123) | | 27 |

FIG. 25K

| JBT0047 class | | Extrinsic Tenase Inhibition assay | |
|---|---|---|---|
| Peptide | Sequence | EC50 (μM) | % Inhibition @ 2.5μM |
| JBT1149 | Ac-FQSKGNVFvFGYFERLRAKL-NH2 (SEQ ID NO: 936) | | 0 |
| JBT1151 | Ac-FQSKKNVFVFGYFERLRAKD-NH2 (SEQ ID NO: 937) | | 0 |
| JBT1152 | Ac-FQSKKNVFFFGYFERLRAKL-NH2 (SEQ ID NO: 735) | | 0 |
| JBT1153 | Ac-FQSKKNVFVFGYFERLGAKL-NH2 (SEQ ID NO: 705) | | 4 |
| JBT1155 | Ac-FQSK-Nmg-NVFVTGYFERLRAKL-NH2 (SEQ ID NO: 125) | | 32 |
| JBT1156 | Ac-FQSKaNVFVDGYFARL-Nle-AKL-NH2 (SEQ ID NO: 126) | | 22 |
| JBT1157 | Ac-FQSKaNVFVAGYFARLRAKL-NH2 (SEQ ID NO: 127) | | 22 |
| JBT1162 | Ac-FQSKpNVFVFGYFERLRAKL-NH2 (SEQ ID NO: 129) | | 51 |
| JBT1396 | Ac-FQSK-Nmg-NVFVAGYFERLRAKL-NH2 (SEQ ID NO: 161) | | 34 |
| JBT1584 | Ac-FQSK-Nmg-NVFVDGYFERL-Aib-AKL-NH2 (SEQ ID NO: 164) | | 57 |
| JBT1585 | Ac-FQSK-Nmg-NVFVTGYFERL-Aib-AKL-NH2 (SEQ ID NO: 165) | | 48 |
| JBT1590 | Ac-FQSKGNVFV[CGYFERL-Aib-AKLC]-NH2 (SEQ ID NO: 401) | | 22 |
| JBT1591 | Ac-FQSKGNVFVDGYF[CRL-Aib-AKLC]-NH2 (SEQ ID NO: 168) | | 23 |
| JBT1592 | Ac-[CFQSKGNVFVDGYFERLC]AKL-NH2 (SEQ ID NO: 402) | | 11 |
| JBT1593 | Ac-FQSK[CNVFVDGYFERLC]AKL-NH2 (SEQ ID NO: 670) | | 13 |
| JBT1594 | Ac-FQSKGNVFV[CGYFERLC]AKL-NH2 (SEQ ID NO: 671) | | 5 |
| JBT1595 | Ac-[CFQSKGNVFVC]GYFERL-Aib-AKL-NH2 (SEQ ID NO: 403) | | 12 |
| JBT1596 | Ac-[CFQSKGC]VFVEGYFERL-Aib-AKL-NH2 (SEQ ID NO: 404) | | 13 |
| JBT1843 | Ac-FQSKGNIFVDGYFERLHAKL-NH2 (SEQ ID NO: 169) | | 7 |
| JBT1844 | Ac-FQSKNNVFVDGYFKRLRAKL-NH2 (SEQ ID NO: 170) | | 6 |
| JBT1845 | Ac-FQSYKHVFVDGYFERLRAKL-NH2 (SEQ ID NO: 249) | | 6 |

FIG. 25L

| JBT0047 class | | Extrinsic Tenase Inhibition assay | |
|---|---|---|---|
| Peptide | Sequence | EC50 (µM) | % Inhibition @ 2.5µM |
| JBT1846 | Ac-FQSKGIVFVDGYFKRLRAKL-NH2 (SEQ ID NO: 250) | | 7 |
| JBT1847 | Ac-YQTKGNVFVDGYFERLRAKL-NH2 (SEQ ID NO: 171) | | 16 |
| JBT1853 | PEG(40kD)-FQSKGNVFVDGYFERL-Aib-AKL-NH2 (SEQ ID NO: 175) | | 56 |
| JBT1855 | Ac-FQSKGNVFVDGYFERL-Aib-AKLC(PEG40kD)-NH2 (SEQ ID NO: 252) | | 59 |

FIG. 26A

| JBT0120 class | | Extrinsic Tenase Inhibition assay | |
|---|---|---|---|
| Peptide | Sequence | EC50 (µM) | % Inhibition @ 2.5µM |
| JBT0120 | Ac-SGASRYKWF[CGMRDMKGTMSC]VWVKFRYDTS-NH2 (SEQ ID NO: 1047) | 0.88 | 45 |
| JBT0124 | Biotin-Ttds-SGASRYKWF[CGMRDMKGTMSC]VWVKFRYDTS-NH2 (SEQ ID NO: 1290) | 1.26 | 36 |
| JBT0247 | Ac-SGASRYKWF[CGMRDMKGTMSC]VWVKFRYDTS-NH2 (SEQ ID NO: 1213) | 0.61 | 42 |
| JBT0248 | Ac-KKSGASRYKWF[CGMRDMKGTMSC]VWVKFRYDTSKK-NH2 (SEQ ID NO: 1001) | 0.27 | 52 |
| JBT0249 | Ac-KKSGASRYKWFCGMRDMKGTMSKK-NH2 (SEQ ID NO: 1214) | 1.06 | 16 |
| JBT0250 | Ac-KKSRYKWF[CGMRDMKGTMSC]VWVKK-NH2 (SEQ ID NO: 1201) | 0.61 | 19 |
| JBT0251 | Ac-KKKWF[CGMRDMKGTMSC]VWVKFKK-NH2 (SEQ ID NO: 1202) | 0.63 | 23 |
| JBT0252 | Ac-KK[CGMRDMKGTMSC]VWVKFRYDKK-NH2 (SEQ ID NO: 1215) | 1.02 | 18 |
| JBT0253 | Ac-KKMRDMKGTMSCVWVKFRYDTSKK-NH2 (SEQ ID NO: 1216) | 0.55 | 23 |
| JBT0319 | Ac-SGASRYKWF[CGMRDMKGTMSC]VWVKFRY-NH2 (SEQ ID NO: 1002) | | 60 |
| JBT0320 | Ac-SGASRYKWF[CGMRDMKGTMSC]VWVK-NH2 (SEQ ID NO: 1103) | 6.40 | 7 |
| JBT0321 | Ac-SGASRYKWF[CGMRDMKGTMSC]V-NH2 (SEQ ID NO: 1217) | | 1 |
| JBT0322 | Ac-SGASRYKWFCGMRDMKGTM-NH2 (SEQ ID NO: 1218) | | 3 |
| JBT0323 | Ac-SRYKWF[CGMRDMKGTMSC]VWVKFRYDTS-NH2 (SEQ ID NO: 1076) | 0.77 | 48 |
| JBT0324 | Ac-KWF[CGMRDMKGTMSC]VWVKFRYDTS-NH2 (SEQ ID NO: 1155) | 2.44 | 18 |
| JBT0325 | Ac-[CGMRDMKGTMSC]VWVKFRYDTS-NH2 (SEQ ID NO: 1219) | | 4 |
| JBT0326 | Ac-RDMKGTMSCVWVKFRYDTS-NH2 (SEQ ID NO: 1220) | | 3 |
| JBT0327 | Ac-SGASRYKWFCGMRDMKGTMS-NH2 (SEQ ID NO: 1222) | | 0 |
| JBT0328 | Ac-SRYKWF[CGMRDMKGTMSC]VW-NH2 (SEQ ID NO: 1223) | | 1 |
| JBT0329 | Ac-KWF[CGMRDMKGTMSC]VWVKF-NH2 (SEQ ID NO: 1156) | | 8 |
| JBT0330 | Ac-[CGMRDMKGTMSC]VWVKFRYD-NH2 (SEQ ID NO: 1224) | | 7 |
| JBT0331 | Ac-MRDMKGTMSCVWVKFRYDTS-NH2 (SEQ ID NO: 1225) | | 5 |

FIG. 26B

| JBT0120 class | | Extrinsic Tenase Inhibition assay | |
|---|---|---|---|
| Peptide | Sequence | EC50 (μM) | % Inhibition @ 2.5μM |
| JBT0332 | Ac-SRYKWFCGMRDMKGTMSCVW-NH2 (SEQ ID NO: 1206) | | 5 |
| JBT0333 | Ac-KWFCGMRDMKGTMSCVWVKF-NH2 (SEQ ID NO: 1207) | | 11 |
| JBT0334 | Ac-CGMRDMKGTMSCVWVKFRYD-NH2 (SEQ ID NO: 1227) | | 3 |
| JBT0409 | Ac-SGASRYKWFSGMRDMKGTMSSVWVKFRYDTS-NH2 (SEQ ID NO: 1204) | | 5 |
| JBT0410 | Ac-SGASRYKWFSG-Nle-RD-Nle-KGT-Nle-SSVWVKFRYDTS-NH2 (SEQ ID NO: 1208) | | 7 |
| JBT0411 | Ac-SGASRYKWF[CG-Nle-RD-Nle-KGT-Nle-SC]VWVKFRYDTS-NH2 (SEQ ID NO: 1104) | | 24 |
| JBT0412 | Ac-KWF[CG-Nle-RD-Nle-KGT-Nle-SC]VWVKF-NH2 (SEQ ID NO: 1209) | | 12 |
| JBT0413 | Ac-KWFSGMRDMKGTMSSVWVKF-NH2 (SEQ ID NO: 1228) | | 2 |
| JBT0414 | Ac-KWFSG-Nle-RD-Nle-KGT-Nle-SSVWVKF-NH2 (SEQ ID NO: 1205) | | 8 |
| JBT0415 | Ac-SRYKWF[CGMRDMKGTMSC]VWVKF-NH2 (SEQ ID NO: 1003) | 0.19 | 52 |
| JBT0416 | Ac-SRYKWF[CG-Nle-RD-Nle-KGT-Nle-SC]VWVKF-NH2 (SEQ ID NO: 1077) | | 46 |
| JBT0417 | Ac-SRYKWFSGMRDMKGTMSSVWVKF-NH2 (SEQ ID NO: 1229) | | 11 |
| JBT0418 | Ac-SRYKWFSG-Nle-RD-Nle-KGT-Nle-SSVWVKF-NH2 (SEQ ID NO: 1210) | | 11 |
| JBT0419 | Ac-SGGRKHKHFLRSNGKPSRALSSMHFWRWSTS-NH2 (SEQ ID NO: 1293) | | 7 |
| JBT0435* | Ac-RKRDVSGKM[CWSGFGSKWFRC]ADMMTYYSVT-NH2 (SEQ ID NO: 1211) | | 5 |
| JBT0436* | Ac-RWSGKSTYS[CDAMVRRMGMKC]FSFGWTDVYK-NH2 (SEQ ID NO: 1212) | | 0 |
| JBT0437 | Ac-ARYKWF[CGMRDMKGTMSC]VWVKF-NH2 (SEQ ID NO: 1048) | | 52 |
| JBT0438 | Ac-SAYKWF[CGMRDMKGTMSC]VWVKF-NH2 (SEQ ID NO: 1078) | | 46 |
| JBT0439 | Ac-SRAKWF[CGMRDMKGTMSC]VWVKF-NH2 (SEQ ID NO: 1105) | | 38 |
| JBT0440 | Ac-SRYAWF[CGMRDMKGTMSC]VWVKF-NH2 (SEQ ID NO: 1106) | | 34 |
| JBT0441 | Ac-SRYKAF[CGMRDMKGTMSC]VWVKF-NH2 (SEQ ID NO: 1230) | | 1 |
| JBT0442 | Ac-SRYKWA[CGMRDMKGTMSC]VWVKF-NH2 (SEQ ID NO: 1231) | | 17 |
| JBT0443 | Ac-SRYKWFAGMRDMKGTMSCVWVKF-NH2 (SEQ ID NO: 1157) | | 7 |
| JBT0444 | Ac-SRYKWF[CAMRDMKGTMSC]VWVKF-NH2 (SEQ ID NO: 1004) | | 63 |

FIG. 26C

| JBT0120 class | | Extrinsic Tenase Inhibition assay | |
|---|---|---|---|
| Peptide | Sequence | EC50 (µM) | % Inhibition @ 2.5µM |
| JBT0445 | Ac-SRYKWF[CGARDMKGTMSC]VWVKF-NH2 (SEQ ID NO: 1107) | | 12 |
| JBT0446 | Ac-SRYKWF[CGMADMKGTMSC]VWVKF-NH2 (SEQ ID NO: 1079) | | 46 |
| JBT0447 | Ac-SRYKWF[CGMRAMKGTMSC]VWVKF-NH2 (SEQ ID NO: 1158) | | 15 |
| JBT0448 | Ac-SRYKWF[CGMRDAKGTMSC]VWVKF-NH2 (SEQ ID NO: 1108) | | 33 |
| JBT0449 | Ac-SRYKWF[CGMRDMAGTMSC]VWVKF-NH2 (SEQ ID NO: 1080) | | 55 |
| JBT0450 | Ac-SRYKWF[CGMRDMKATMSC]VWVKF-NH2 (SEQ ID NO: 1159) | | 34 |
| JBT0451 | Ac-SRYKWF[CGMRDMKGAMSC]VWVKF-NH2 (SEQ ID NO: 1081) | | 46 |
| JBT0452 | Ac-SRYKWF[CGMRDMKGTASC]VWVKF-NH2 (SEQ ID NO: 1109) | | 31 |
| JBT0453 | Ac-SRYKWF[CGMRDMKGTMAC]VWVKF-NH2 (SEQ ID NO: 1110) | 0.97 | 40 |
| JBT0454 | Ac-SRYKWF[CGMRDMKGTMSA]VWVKF-NH2 (SEQ ID NO: 1160) | | 0 |
| JBT0455 | Ac-SRYKWF[CGMRDMKGTMSC]AWVKF-NH2 (SEQ ID NO: 1049) | 0.95 | 30 |
| JBT0456 | Ac-SRYKWF[CGMRDMKGTMSC]VAKF-NH2 (SEQ ID NO: 1232) | | 0 |
| JBT0457 | Ac-SRYKWF[CGMRDMKGTMSC]VWAKF-NH2 (SEQ ID NO: 1161) | | 17 |
| JBT0458 | Ac-SRYKWF[CGMRDMKGTMSC]VWVAF-NH2 (SEQ ID NO: 1082) | | 52 |
| JBT0459 | Ac-SRYKWF[CGMRDMKGTMSC]VWVKA-NH2 (SEQ ID NO: 1083) | | 38 |
| JBT0460 | Ac-RYKWF[CGMRDMKGTMSC]VWVKF-NH2 (SEQ ID NO: 1050) | | 51 |
| JBT0461 | Ac-YKWF[CGMRDMKGTMSC]VWVKF-NH2 (SEQ ID NO: 1111) | | 40 |
| JBT0462 | Ac-SRYKWFGM[CRDMKGTMSC]VWVKF-NH2 (SEQ ID NO: 1233) | | 0 |
| JBT0463 | Ac-SRYKWFGMRD[CMKGTMSC]VWVKF-NH2 (SEQ ID NO: 1234) | | 11 |
| JBT0464 | Ac-SRYKWFGMRDMK[CGTMSC]VWVKF-NH2 (SEQ ID NO: 1235) | | 10 |
| JBT0465 | Ac-SRYKWF[CGMRDMKGTC]MSVWVKF-NH2 (SEQ ID NO: 1236) | | 7 |
| JBT0466 | Ac-SRYKWF[CGMRDMKC]GTMSVWVKF-NH2 (SEQ ID NO: 1237) | | 11 |
| JBT0467 | Ac-SRYKWF[CGMRDC]MKGTMSVWVKF-NH2 (SEQ ID NO: 1238) | | 11 |
| JBT0468 | Ac-SRYKWFG[CMRDMKGTMC]SVWVKF-NH2 (SEQ ID NO: 1239) | | 7 |

FIG. 26D

| JBT0120 class | | Extrinsic Tenase Inhibition assay | |
|---|---|---|---|
| Peptide | Sequence | EC50 (µM) | % Inhibition @ 2.5µM |
| JBT0469 | Ac-SRYKWFGM[CRDMKGTC]MSVWVKF-NH2 (SEQ ID NO: 1240) | | 11 |
| JBT0470 | Ac-SRYKWFGMR[CDMKGC]TMSVWVKF-NH2 (SEQ ID NO: 1162) | | 2 |
| JBT0617 | Ac-SRYKWF[homoC-GMRDMKGTMSC]VWVKF-NH2 (SEQ ID NO: 1112) | | 21 |
| JBT0618 | Ac-SRYKWF[CGMRDMKGTMS-homoC]VWVKF-NH2 (SEQ ID NO: 1163) | | 11 |
| JBT0619 | Ac-SRYKWF[homoC-GMRDMKGTMS-homoC]VWVKF-NH2 (SEQ ID NO: 1241) | | 1 |
| JBT0620 | Ac-SRYKWF[Dap-GMRDMKGTMS-D]VWVKF-NH2 (SEQ ID NO: 1242) | | 0 |
| JBT0625 | Ac-SRYKWF[CMRDMKGTMSC]VWVKF-NH2 (SEQ ID NO: 1244) | | 0 |
| JBT0626 | Ac-SRYKWF[CGMRDKGTMSC]VWVKF-NH2 (SEQ ID NO: 1164) | | 7 |
| JBT0627 | Ac-SRYKWF[CGMRDMGTMSC]VWVKF-NH2 (SEQ ID NO: 1165) | | 3 |
| JBT0628 | Ac-SRYKWF[CGMRDMKGMSC]VWVKF-NH2 (SEQ ID NO: 1166) | | 0 |
| JBT0629 | Ac-SRYKWF[cGMRDMKGTMSC]VWVKF-NH2 (SEQ ID NO: 1167) | | 3 |
| JBT0631 | Ac-SRYKWF[CGmRDMKGTMSC]VWVKF-NH2 (SEQ ID NO: 1113) | | 18 |
| JBT0632 | Ac-SRYKWF[CGMrDMKGTMSC]VWVKF-NH2 (SEQ ID NO: 1245) | | 0 |
| JBT0633 | Ac-SRYKWF[CGMRdMKGTMSC]VWVKF-NH2 (SEQ ID NO: 1168) | | 2 |
| JBT0634 | Ac-SRYKWF[CGMRDmKGTMSC]VWVKF-NH2 (SEQ ID NO: 1051) | 0.47 | 44 |
| JBT0635 | Ac-SRYKWF[CGMRDMkGTMSC]VWVKF-NH2 (SEQ ID NO: 1114) | | 10 |
| JBT0637 | Ac-SRYKWF[CGMRDMKGmMSC]VWVKF-NH2 (SEQ ID NO: 1169) | | 0 |
| JBT0638 | Ac-SRYKWF[CGMRDMKGTmSC]VWVKF-NH2 (SEQ ID NO: 1246) | | 0 |
| JBT0639 | Ac-SRYKWF[CGMRDMKGTMsC]VWVKF-NH2 (SEQ ID NO: 1170) | | 3 |
| JBT0640 | Ac-SRYKWF[CGMRDMKGTMSc]VWVKF-NH2 (SEQ ID NO: 1171) | | 1 |
| JBT0641 | Ac-SRYKWF[CPMRDMKGTMSC]VWVKF-NH2 (SEQ ID NO: 1247) | | 0 |
| JBT0642 | Ac-SRYKWF[CGPRDMKGTMSC]VWVKF-NH2 (SEQ ID NO: 1248) | | 0 |
| JBT0643 | Ac-SRYKWF[CGMPDMKGTMSC]VWVKF-NH2 (SEQ ID NO: 1006) | | 31 |
| JBT0644 | Ac-SRYKWF[CGMRPMKGTMSC]VWVKF-NH2 (SEQ ID NO: 1172) | | 17 |

FIG. 26E

| JBT0120 class | | Extrinsic Tenase Inhibition assay | |
|---|---|---|---|
| Peptide | Sequence | EC50 (µM) | % Inhibition @ 2.5µM |
| JBT0645 | Ac-SRYKWF[CGMRDPKGTMSC]VWVKF-NH2 (SEQ ID NO: 1084) | | 23 |
| JBT0646 | Ac-SRYKWF[CGMRDMPGTMSC]VWVKF-NH2 (SEQ ID NO: 1173) | | 2 |
| JBT0647 | Ac-SRYKWF[CGMRDMKPTMSC]VWVKF-NH2 (SEQ ID NO: 1249) | | 0 |
| JBT0648 | Ac-SRYKWF[CGMRDMKGPMSC]VWVKF-NH2 (SEQ ID NO: 1174) | | 3 |
| JBT0649 | Ac-SRYKWF[CGMRDMKGTPSC]VWVKF-NH2 (SEQ ID NO: 1175) | | 2 |
| JBT0650 | Ac-SRYKWF[CGMRDMKGTMPC]VWVKF-NH2 (SEQ ID NO: 1250) | | 0 |
| JBT0787 | Ac-SRYKWF[CG-SeMet-RD-SeMet-KGT-SeMet-SC]VWVKF-NH2 (SEQ ID NO: 1292) | | 55 |
| JBT1416 | Ac-DRYKWF[CGMRDMKGTMSC]VWVKF-NH2 (SEQ ID NO: 1007) | | 47 |
| JBT1426 | Ac-SRYKWF[CGMRDMDGTMSC]VWVKF-NH2 (SEQ ID NO: 1008) | | 40 |
| JBT1436 | Ac-FRYKWF[CGMRDMKGTMSC]VWVKF-NH2 (SEQ ID NO: 1053) | | 51 |
| JBT1437 | Ac-SFYKWF[CGMRDMKGTMSC]VWVKF-NH2 (SEQ ID NO:1010) | | 53 |
| JBT1438 | Ac-SRFKWF[CGMRDMKGTMSC]VWVKF-NH2 (SEQ ID NO: 1011) | | 49 |
| JBT1445 | Ac-SRYKWF[CGMRDFKGTMSC]VWVKF-NH2 (SEQ ID NO: 1012) | | 39 |
| JBT1446 | Ac-SRYKWF[CGMRDMFGTMSC]VWVKF-NH2 (SEQ ID NO: 1054) | | 46 |
| JBT1448 | Ac-SRYKWF[CGMRDMKGFMSC]VWVKF-NH2 (SEQ ID NO: 1123) | | 47 |
| JBT1449 | Ac-SRYKWF[CGMRDMKGTFSC]VWVKF-NH2 (SEQ ID NO: 1013) | | 55 |
| JBT1455 | Ac-GRYKWF[CGMRDMKGTMSC]VWVKF-NH2 (SEQ ID NO: 1014) | | 49 |
| JBT1474 | Ac-KRYKWF[CGMRDMKGTMSC]VWVKF-NH2 (SEQ ID NO: 1016) | | 59 |
| JBT1481 | Ac-SRYKWF[CGMKDMKGTMSC]VWVKF-NH2 (SEQ ID NO: 1017) | | 55 |
| JBT1483 | Ac-SRYKWF[CGMRDKKGTMSC]VWVKF-NH2 (SEQ ID NO: 1057) | | 50 |
| JBT1492 | Ac-LRYKWF[CGMRDMKGTMSC]VWVKF-NH2 (SEQ ID NO: 1018) | | 52 |
| JBT1493 | Ac-SLYKWF[CGMRDMKGTMSC]VWVKF-NH2 (SEQ ID NO: 1060) | | 43 |
| JBT1502 | Ac-SRYKWF[CGMRDLKGTMSC]VWVKF-NH2 (SEQ ID NO: 1019) | | 46 |
| JBT1506 | Ac-SRYKWF[CGMRDMKGTLSC]VWVKF-NH2 (SEQ ID NO:1064) | | 45 |

FIG. 26F

| JBT0120 class | | Extrinsic Tenase Inhibition assay | |
|---|---|---|---|
| Peptide | Sequence | EC50 (μM) | % Inhibition @ 2.5μM |
| JBT1512 | Ac-SRYKWF[CGMRDMKGTMSC]VWVKL-NH2 (SEQ ID NO: 1020) | | 44 |
| JBT1541 | Ac-SRYKWF[CGMRDMKGTMSC]VWVPF-NH2 (SEQ ID NO: 1023) | | 41 |
| JBT1544 | H-SRYKWF[CGMRDMKGTMSC]VWVKF-NH2 (SEQ ID NO: 1024) | | 59 |
| JBT1570 | Ac-SRYKWF[CGMRDIKGTMSC]VWVKF-NH2 (SEQ ID NO: 1025) | | 41 |

FIG. 27A

| JBT0122 class | | Extrinsic Tenase Inhibition assay | |
|---|---|---|---|
| Peptide | Sequence | EC50 (µM) | % Inhibition @ 2.5µM |
| JBT0122 | Ac-SGYASFPLAVQLHVSKRSKEMALARLYYKTS-NH2 (SEQ ID NO: 2002) | 6.70 | 7 |
| JBT0126 | Biotin-Tds-SGYASFPLAVQLHVSKRSKEMALARLYYKTS-NH2 (SEQ ID NO: 2498) | 5.05 | 5 |
| JBT0221 | Ac-KKSGYASFPLAVQLHVSKRSKEMALARLYYKTSKK-NH2 (SEQ ID NO: 2003) | 3.37 | 19 |
| JBT0222 | Ac-MKSRSLGLAYFAKHSSLEVLQTRKVAAPYY-NH2 (SEQ ID NO: 2127) | | 4 |
| JBT0223 | Ac-KMQLRVYASTAHSRYLLGSSLFPKYAEVKA-NH2 (SEQ ID NO: 2297) | | 4 |
| JBT0224 | Ac-KKSGYASFPLAVQLHVSKRSKEMALARLYYKK-NH2 (SEQ ID NO: 2298) | 3.49 | 18 |
| JBT0225 | Ac-KKSGYASFPLAVQLHVSKRSKEMALARKK-NH2 (SEQ ID NO: 2128) | | 0 |
| JBT0226 | Ac-KKSGYASFPLAVQLHVSKRSKEMAKK-NH2 (SEQ ID NO: 2299) | | 0 |
| JBT0227 | Ac-KKSGYASFPLAVQLHVSKRSKKK-NH2 (SEQ ID NO: 2300) | | 5 |
| JBT0228 | Ac-KKASFPLAVQLHVSKRSKEMALARLYYKTSKK-NH2 (SEQ ID NO: 2016) | 6.93 | 9 |
| JBT0229 | Ac-KKPLAVQLHVSKRSKEMALARLYYKTSKK-NH2 (SEQ ID NO: 2129) | | 0 |
| JBT0230 | Ac-KKVQLHVSKRSKEMALARLYYKTSKK-NH2 (SEQ ID NO: 2301) | | 0 |
| JBT0231 | Ac-KKHVSKRSKEMALARLYYKTSKK-NH2 (SEQ ID NO: 2302) | | 0 |
| JBT0232 | Ac-KKGYASFPLAVQLHVSKRSKEMKK-NH2 (SEQ ID NO: 2303) | | 2 |
| JBT0233 | Ac-KKYASFPLAVQLHVSKRSKEMAKK-NH2 (SEQ ID NO: 2304) | | 6 |
| JBT0234 | Ac-KKVQLHVSKRSKEMALARLYYKKK-NH2 (SEQ ID NO: 2305) | | 3 |
| JBT0235 | Ac-KKQLHVSKRSKEMALARLYYKTKK-NH2 (SEQ ID NO: 2306) | | 0 |
| JBT0236 | Ac-KKLHVSKRSKEMALARLYYKTSKK-NH2 (SEQ ID NO: 2307) | | 0 |
| JBT0237 | Ac-KKSGYASFPLAVQLHVSKRSKEKK-NH2 (SEQ ID NO: 2308) | | 2 |
| JBT0359 | Ac-KKSGYASFPLAVQLHVSKRSKEMA-NH2 (SEQ ID NO: 2309) | | 6 |
| JBT0360 | Ac-SFPLAVQLHVSKRSKEMA-NH2 (SEQ ID NO: 2310) | | 2 |
| JBT0361 | Ac-FPLAVQLHVSKRSKEMA-NH2 (SEQ ID NO: 2311) | | 9 |
| JBT0362 | Ac-ASFPLAVQLHVSKRSKEM-NH2 (SEQ ID NO: 2312) | | 6 |
| JBT0363 | Ac-ASFPLAVQLHVSKRSKE-NH2 (SEQ ID NO: 2313) | | 9 |

FIG. 27B

| JBT0122 class | | Extrinsic Tenase Inhibition assay | |
|---|---|---|---|
| Peptide | Sequence | EC50 (µM) | % Inhibition @ 2.5µM |
| JBT0364 | Ac-ASFPLAVQLHVSKRSKEMAL-NH2 (SEQ ID NO: 2314) | | 12 |
| JBT0365 | Ac-ASFPLAVQLHVSKRSKEMALA-NH2 (SEQ ID NO: 2315) | | 9 |
| JBT0366 | Ac-ASFPLAVQLHVSKRSKEMALAR-NH2 (SEQ ID NO: 2316) | | 11 |
| JBT0367 | Ac-ASFPLAVQLHVSKRSKEMALARL-NH2 (SEQ ID NO: 2317) | | 10 |
| JBT0368 | Ac-ASFPLAVQLHVSKRSKEMALARLY-NH2 (SEQ ID NO: 2130) | | 8 |
| JBT0369 | Ac-ASFPLAVQLHVSKRSKEMALARLYY-NH2 (SEQ ID NO: 2017) | | 9 |
| JBT0370 | Ac-YASFPLAVQLHVSKRSKEMA-NH2 (SEQ ID NO: 2318) | | 0 |
| JBT0371 | Ac-GYASFPLAVQLHVSKRSKEMA-NH2 (SEQ ID NO: 2319) | | 5 |
| JBT0660 | Ac-AGYASFPLAVQLHVSKRSKEMALARLYYKTS-NH2 (SEQ ID NO: 2004) | | 0 |
| JBT0661 | Ac-SAYASFPLAVQLHVSKRSKEMALARLYYKTS-NH2 (SEQ ID NO: 2005) | | 3 |
| JBT0662 | Ac-SGAASFPLAVQLHVSKRSKEMALARLYYKTS-NH2 (SEQ ID NO: 2131) | | 0 |
| JBT0664 | Ac-SGYAAFPLAVQLHVSKRSKEMALARLYYKTS-NH2 (SEQ ID NO: 2006) | | 3 |
| JBT0665 | Ac-SGYASAPLAVQLHVSKRSKEMALARLYYKTS-NH2 (SEQ ID NO: 2132) | | 0 |
| JBT0666 | Ac-SGYASFALAVQLHVSKRSKEMALARLYYKTS-NH2 (SEQ ID NO: 2001) | | 5 |
| JBT0667 | Ac-SGYASFPAAVQLHVSKRSKEMALARLYYKTS-NH2 (SEQ ID NO: 2018) | | 0 |
| JBT0669 | Ac-SGYASFPLAAQLHVSKRSKEMALARLYYKTS-NH2 (SEQ ID NO: 2133) | | 0 |
| JBT0670 | Ac-SGYASFPLAVALHVSKRSKEMALARLYYKTS-NH2 (SEQ ID NO: 2007) | | 2 |
| JBT0671 | Ac-SGYASFPLAVQAHVSKRSKEMALARLYYKTS-NH2 (SEQ ID NO: 2019) | | 7 |
| JBT0672 | Ac-SGYASFPLAVQLAVSKRSKEMALARLYYKTS-NH2 (SEQ ID NO: 2134) | | 3 |
| JBT0673 | Ac-SGYASFPLAVQLHASKRSKEMALARLYYKTS-NH2 (SEQ ID NO: 2135) | | 5 |
| JBT0674 | Ac-SGYASFPLAVQLHVAKRSKEMALARLYYKTS-NH2 (SEQ ID NO: 2008) | | 5 |
| JBT0675 | Ac-SGYASFPLAVQLHVSARSKEMALARLYYKTS-NH2 (SEQ ID NO: 2136) | | 7 |
| JBT0676 | Ac-SGYASFPLAVQLHVSKASKEMALARLYYKTS-NH2 (SEQ ID NO: 2137) | | 1 |
| JBT0677 | Ac-SGYASFPLAVQLHVSKRAKEMALARLYYKTS-NH2 (SEQ ID NO: 2009) | | 2 |

FIG. 27C

| JBT0122 class | | Extrinsic Tenase Inhibition assay | |
|---|---|---|---|
| Peptide | Sequence | EC50 (μM) | % Inhibition @ 2.5μM |
| JBT0678 | Ac-SGYASFPLAVQLHVSKRSAEMALARLYYKTS-NH2 (SEQ ID NO: 2010) | | 2 |
| JBT0679 | Ac-SGYASFPLAVQLHVSKRSKAMALARLYYKTS-NH2 (SEQ ID NO: 2020) | | 3 |
| JBT0680 | Ac-SGYASFPLAVQLHVSKRSKEAALARLYYKTS-NH2 (SEQ ID NO: 2138) | | 3 |
| JBT0682 | Ac-SGYASFPLAVQLHVSKRSKEMAAARLYYKTS-NH2 (SEQ ID NO: 2139) | | 0 |
| JBT0684 | Ac-SGYASFPLAVQLHVSKRSKEMALAALYYKTS-NH2 (SEQ ID NO: 2011) | | 2 |
| JBT0685 | Ac-SGYASFPLAVQLHVSKRSKEMALARAYYKTS-NH2 (SEQ ID NO: 2021) | | 1 |
| JBT0686 | Ac-SGYASFPLAVQLHVSKRSKEMALARLAYKTS-NH2 (SEQ ID NO: 2140) | | 1 |
| JBT0687 | Ac-SGYASFPLAVQLHVSKRSKEMALARLYAKTS-NH2 (SEQ ID NO: 2141) | | 0 |
| JBT0688 | Ac-SGYASFPLAVQLHVSKRSKEMALARLYYATS-NH2 (SEQ ID NO: 2012) | | 2 |
| JBT0689 | Ac-SGYASFPLAVQLHVSKRSKEMALARLYYKAS-NH2 (SEQ ID NO: 2013) | | 2 |
| JBT0690 | Ac-SGYASFPLAVQLHVSKRSKEMALARLYYKTA-NH2 (SEQ ID NO: 2014) | | 3 |
| JBT1579 | Ac-GYASFPLAVQLHVAKRSKEMA-NH2 (SEQ ID NO: 2015) | | 5 |
| JBT1580 | Ac-GYASFALSVQLHVSKRSKEMA-NH2 (SEQ ID NO: 2320) | | 6 |
| JBT1581 | Ac-GYASFALAVQLHVAKRSKEMA-NH2 (SEQ ID NO: 2321) | | 13 |
| JBT1582 | Ac-GYASFALAVQLHVMKRSKEMA-NH2 (SEQ ID NO: 2022) | | 7 |
| JBT1583 | Ac-GYASFALAVQLHVMKRSKEMA-NH2 (SEQ ID NO: 2322) | | 12 |
| JBT1602 | Ac-LAVQLHVSKRSKEMALARL-NH2 (SEQ ID NO: 2326) | | 0 |

FIG. 28A

| JBT0047 class | | Thrombin generation assay | | | | |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | EC₅₀ (µM), FVIII-inhibited plasma | % FVIII-equivalent activity in FVIII deficient plasma @ 10µM peptide | % FVIII-equivalent activity in FVIII deficient plasma @ 1.1µM peptide |
| JBT0047 | Ac-SGVGRLQVAFQSKKNVFGYFERLRAKLTS-NH2 (SEQ ID NO: 253) | 156 | 87 | 0.89 | 24.6 | 20.0 |
| JBT0131 | Biotin-Ttds-AFQSKKNVFGYFERLRAKL-NH2 (SEQ ID NO: 964) | 106 | | | 4.5 | |
| JBT0132 | Biotin-Ttds-FQSKKNVFGYFERLRAKLT-NH2 (SEQ ID NO: 965) | 123 | | | 5.3 | |
| JBT0133 | Biotin-Ttds-QSKKNVFGYFERLRAKLT-NH2 (SEQ ID NO: 966) | 28 | | | 6.7 | |
| JBT0134 | Biotin-Ttds-QSKKNVFGYFERLRAK-NH2 (SEQ ID NO: 967) | 11 | | | | |
| JBT0155 | Ac-KKSGVGRLQVAFQSKKNVFGYFERLRAKLTSKK-NH2 (SEQ ID NO: 8) | 49 | | | | |
| JBT0158 | Ac-KKSGVGRLQVAFQSKKNVFGYFERLRAKKK-NH2 (SEQ ID NO: 9) | 30 | | | | |
| JBT0162 | Ac-KKGRLQVAFQSKKNVFGYFERLRAKLTSKK-NH2 (SEQ ID NO: 10) | 54 | | | | |
| JBT0163 | Ac-KKQVAFQSKKNVFGYFERLRAKLTSKK-NH2 (SEQ ID NO: 11) | 69 | | | | |
| JBT0164 | Ac-KKFQSKKNVFGYFERLRAKLTSKK-NH2 (SEQ ID NO: 12) | 39 | | | | |
| JBT0169 | Ac-KKAFQSKKNVFGYFERLRAKKK-NH2 (SEQ ID NO: 254) | 21 | | | | |
| JBT0170 | Ac-KKFQSKKNVFGYFERLRAKLKK-NH2 (SEQ ID NO: 13) | 68 | | | | |
| JBT0171 | Ac-KKQSKKNVFGYFERLRAKLTKK -NH2 (SEQ ID NO: 255) | 33 | | | | |
| JBT0174 | Ac-KKAFQSKKNVFGYFERLRAKLKK-NH2 (SEQ ID NO: 14) | 49 | | | | |

FIG. 28B

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0175 | Ac-KKAFQSKKNVFVFGYFERLRAKLTKK-NH2 (SEQ ID NO: 182) | 49 | | | | |
| JBT0293 | Ac-FQSKKNVFVFGYFERLRAKL-NH2 (SEQ ID NO: 256) | 106 | 34 | 1.60 | 7.1 | |
| JBT0294 | Ac-YQSKKNVFVFGYFERLRAKL-NH2 (SEQ ID NO: 257) | 122 | | | 8.2 | |
| JBT0296 | Ac-FQNKKNVFVFGYFERLRAKL-NH2 (SEQ ID NO: 407) | 79 | | | | |
| JBT0297 | Ac-FQSKNNVFVFGYFERLRAKL-NH2 (SEQ ID NO: 183) | 147 | | | 11.3 | |
| JBT0298 | Ac-FQSKQNVFVFGYFERLRAKL-NH2 (SEQ ID NO: 747) | 109 | | | | |
| JBT0299 | Ac-FQSKKNVFAFGYFERLRAKL-NH2 (SEQ ID NO: 408) | 63 | | | | |
| JBT0300 | Ac-FQSKKNVFSFGYFERLRAKL-NH2 (SEQ ID NO: 409) | 40 | | | | |
| JBT0301 | Ac-FQSKKNVFTFGYFERLRAKL-NH2 (SEQ ID NO: 410) | 49 | | | | |
| JBT0302 | Ac-FQSKKNVFVAGYFERLRAKL-NH2 (SEQ ID NO: 258) | 220 | | | 18.5 | |
| JBT0303 | Ac-FQSKKNVFVDGYFERLRAKL-NH2 (SEQ ID NO: 184) | 220 | 126 | 0.85 | 21.8 | |
| JBT0304 | Ac-FQSKKNVFVLGYFERLRAKL-NH2 (SEQ ID NO: 259) | 138 | | | | |
| JBT0305 | Ac-FQSKKNVFVQGYFERLRAKL-NH2 (SEQ ID NO: 260) | 207 | 113 | | 20.5 | |
| JBT0306 | Ac-FQSKKNVFVSGYFERLRAKL-NH2 (SEQ ID NO: 185) | 247 | 113 | | 17.4 | |
| JBT0307 | Ac-FQSKKNVFVYGYFERLRAKL-NH2 (SEQ ID NO: 261) | 182 | 81 | | 16.8 | |
| JBT0308 | Ac-FQSKKNVFVFGYKERLRAKL-NH2 (SEQ ID NO: 411) | 133 | | | | |
| JBT0309 | Ac-FQSKKNVFVFGYYERLRAKL-NH2 (SEQ ID NO: 412) | 123 | | | | |
| JBT0310 | Ac-FQSKKNVFVFGYFDRLRAKL-NH2 (SEQ ID NO: 262) | 163 | 50 | | | |

FIG. 28C

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC₅₀ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0311 | Ac-FQSKKNVFVFGYFERLRAKN-NH2 (SEQ ID NO: 748) | 27 | | | | |
| JBT0335 | Ac-FQSKKKNVFVFGYFERLRAK-NH2 (SEQ ID NO: 749) | 28 | | | | |
| JBT0336 | Ac-FQSKNNVFVAGYFDRLRAKL-OH (SEQ ID NO: 263) | 186 | 62 | | | |
| JBT0337 | Ac-FQSKNNVFVDGYFDRLRAKL-NH2 (SEQ ID NO: 16) | 219 | 144 | | | |
| JBT0338 | Ac-FQSKNNVFVQGYFDRLRAKL-NH2 (SEQ ID NO: 17) | 197 | 133 | | | |
| JBT0339 | Ac-FQSKNNVFVSGYFDRLRAKL-NH2 (SEQ ID NO: 18) | 230 | 136 | | | |
| JBT0340 | Ac-FQSKNNVFVYGYFDRLRAKL-NH2 (SEQ ID NO: 186) | 197 | 122 | | | |
| JBT0341 | Ac-FQSKNNVFVFGYFDRLRAKL-NH2 (SEQ ID NO: 187) | 193 | 100 | | | |
| JBT0342 | Ac-FQSKNNVFVDGYFERLRAKL-NH2 (SEQ ID NO: 19) | 244 | 178 | | 29.7 | 28.1 |
| JBT0343 | Ac-FQSKKNVFVDGYFDRLRAKL-NH2 (SEQ ID NO: 188) | 239 | 126 | | | |
| JBT0374 | Ac-FQSKDNVFVFGYFERLRAKL-NH2 (SEQ ID NO: 20) | 216 | 128 | | | |
| JBT0375 | Ac-FQSKGNVFVFGYFERLRAKL-NH2 (SEQ ID NO: 190) | 180 | 140 | 0.47 | 22.9 | 22.9 |
| JBT0376 | Ac-FQSKKNAFVFGYFERLRAKL-NH2 (SEQ ID NO: 414) | 101 | 22 | | | |
| JBT0377 | Ac-FQSKKNQFVFGYFERLRAKL-NH2 (SEQ ID NO: 264) | 180 | 75 | | | |
| JBT0378 | Ac-FQSKKNVFVEGYFERLRAKL-NH2 (SEQ ID NO: 21) | 245 | 148 | | 30.7 | 21.2 |
| JBT0379 | Ac-FQSKKNVFVTGYFERLRAKL-NH2 (SEQ ID NO: 22) | 226 | 123 | | | |
| JBT0380 | Ac-FQSKKNVFVFGYFERLRAKL-NH2 (SEQ ID NO: 191) | 199 | 102 | | | |
| JBT0381 | Ac-FQSPKNVFVFGYFERLRAKL-NH2 (SEQ ID NO: 265) | 173 | 76 | | | |

FIG. 28D

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0386 | Ac-FQSKKNPFVFGYFERLRAKL-NH2 (SEQ ID NO: 415) | 85 | | | | |
| JBT0388 | Ac-FQSKKNVHVFGYFERLRAKL-NH2 (SEQ ID NO: 192) | 185 | 82 | | | |
| JBT0389 | Ac-FQSKKNVVVFGYFERLRAKL-NH2 (SEQ ID NO: 673) | 34 | | | | |
| JBT0390 | Ac-FQSKKNVFQFGYFERLRAKL-NH2 (SEQ ID NO: 674) | 28 | | | | |
| JBT0391 | Ac-FQSKKNVFVGGYFERLRAKL-NH2 (SEQ ID NO: 266) | 178 | 62 | | | |
| JBT0392 | Ac-FQSKKNVFVHGYFERLRAKL-NH2 (SEQ ID NO: 23) | 228 | 112 | | | |
| JBT0393 | Ac-FQSKKNVFVKGYFERLRAKL-NH2 (SEQ ID NO: 193) | 268 | 161 | | 38.8 | 30.1 |
| JBT0394 | Ac-FQSKKNVFVMGYFERLRAKL-NH2 (SEQ ID NO: 24) | 115 | 43 | | | |
| JBT0395 | Ac-FQSKKNVFVNGYFERLRAKL-NH2 (SEQ ID NO: 25) | 235 | 107 | | | |
| JBT0396 | Ac-FQSKKNVFVPGYFERLRAKL-NH2 (SEQ ID NO: 194) | 196 | 85 | | | |
| JBT0397 | Ac-FQSKKNVFVRGYFERLRAKL-NH2 (SEQ ID NO: 195) | 240 | 128 | | | |
| JBT0402 | Biotin-Ttds-FQSKKNNVFVFGYFERLRAKL-NH2 (SEQ ID NO: 973) | 185 | 159 | | | |
| JBT0403 | Biotin-Ttds-FQSKKNVFVDGYFERLRAKL-NH2 (SEQ ID NO: 972) | 253 | 188 | | | |
| JBT0404 | Biotin-Ttds-FQSKKNVFVFGYFDRLRAKL-NH2 (SEQ ID NO: 974) | 115 | 52 | | | |
| JBT0405 | Biotin-FQSKKNVFVFGYFERLRAKL-NH2 (SEQ ID NO: 975) | 142 | 152 | | | |
| JBT0406 | Ac-Ttds-FQSKKNVFVFGYFERLRAKL-NH2 (SEQ ID NO: 268) | 114 | 63 | | | |
| JBT0471 | Ac-FQSKGNVFVTGYFERLRAKL-NH2 (SEQ ID NO: 26) | 193 | 164 | | 42.5 | 34.7 |
| JBT0472 | Ac-FQSKGNVFVNGYFERLRAKL-NH2 (SEQ ID NO: 27) | 197 | 159 | | | |

FIG. 28E

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0473 | Ac-FQSKGNVFVHGYFERLRAKL-NH2 (SEQ ID NO: 28) | 188 | 145 | | | |
| JBT0474 | Ac-FQSKGNVFVKGYFERLRAKL-NH2 (SEQ ID NO: 29) | 200 | 191 | | 50.5 | 45.2 |
| JBT0475 | Ac-FQSKGNVFVEGYFERLRAKL-NH2 (SEQ ID NO: 30) | 202 | 165 | | | |
| JBT0476 | Ac-FQSKGNVFVDGYFDRLRAKL-NH2 (SEQ ID NO: 31) | 202 | 164 | | 43.2 | 41.5 |
| JBT0477 | Ac-FQSKGNVFVDGYFERLRAKL-NH2 (SEQ ID NO: 32) | 231 | 194 | 0.26 | 47.2 | 41.3 |
| JBT0478 | Ac-FQSKDNVFVTGYFERLRAKL-NH2 (SEQ ID NO: 33) | 161 | 104 | | | |
| JBT0479 | Ac-FQSKDNVFVNGYFERLRAKL-NH2 (SEQ ID NO: 34) | 161 | 105 | | | |
| JBT0480 | Ac-FQSKDNVFVHGYFERLRAKL-NH2 (SEQ ID NO: 35) | 180 | 125 | | | |
| JBT0481 | Ac-FQSKDNVFVKGYFERLRAKL-NH2 (SEQ ID NO: 36) | 168 | 124 | | | |
| JBT0482 | Ac-FQSKDNVFVEGYFERLRAKL-NH2 (SEQ ID NO: 37) | 183 | 133 | | | |
| JBT0483 | Ac-FQSKDNVFVDGYFERLRAKL-NH2 (SEQ ID NO: 38) | 191 | 136 | | | |
| JBT0484 | Ac-FQSKDNVFVDGYFDRLRAKL-NH2 (SEQ ID NO: 976) | 178 | 111 | | | |
| JBT0485 | Ac-FQSKNNVFVTGYFERLRAKL-NH2 (SEQ ID NO: 39) | 186 | 150 | | | |
| JBT0486 | Ac-FQSKNNVFVNGYFERLRAKL-NH2 (SEQ ID NO: 40) | 171 | 112 | | | |
| JBT0487 | Ac-FQSKNNVFVHGYFERLRAKL-NH2 (SEQ ID NO: 41) | 178 | 138 | | | |
| JBT0488 | Ac-FQSKNNVFVKGYFERLRAKL-NH2 (SEQ ID NO: 42) | 193 | 153 | | | |
| JBT0489 | Ac-FQSKNNVFVEGYFERLRAKL-NH2 (SEQ ID NO: 43) | 185 | 148 | | | |
| JBT0490 | Ac-FQSKQNVFVTGYFERLRAKL-NH2 (SEQ ID NO: 44) | 162 | 79 | | | |

FIG. 28F

| JBT0047 class | | Thrombin generation assay | | EC$_{50}$ (µM), FVIII-inhibited plasma | % FVIII-equivalent activity in FVIII deficient plasma @ 10µM peptide | % FVIII-equivalent activity in FVIII deficient plasma @ 1.1µM peptide |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | | | |
| JBT0491 | Ac-FQSKQNVFVNGYFERLRAKL-NH2 (SEQ ID NO: 197) | 169 | 96 | | | |
| JBT0492 | Ac-FQSKQNVFVHGYFERLRAKL-NH2 (SEQ ID NO: 198) | 124 | 69 | | | |
| JBT0493 | Ac-FQSKQNVFVKGYFERLRAKL-NH2 (SEQ ID NO: 199) | 151 | 92 | | | |
| JBT0494 | Ac-FQSKQNVFVDGYFERLRAKL-NH2 (SEQ ID NO: 45) | 163 | 102 | | | |
| JBT0495 | Ac-FQSKQNVFVEGYFERLRAKL-NH2 (SEQ ID NO: 200) | 156 | 93 | | | |
| JBT0497 | Ac-NnmetPhe-QSKGNVFVFGYFERLRAKL-NH2 (SEQ ID NO: 201) | 165 | 106 | | | |
| JBT0499 | Ac-FQS-NnmetLys-GNVFVFGYFERLRAKL-NH2 (SEQ ID NO: 202) | 192 | 129 | | | |
| JBT0500 | Ac-FQSK-NnmetGly-NVFVFGYFERLRAKL-NH2 (SEQ ID NO: 46) | 254 | 239 | 0.17 | | 51.1 |
| JBT0501 | Ac-FQSKGN-NnmetV-FVFVFGYFERLRAKL-NH2 (SEQ ID NO: 417) | 95 | 21 | | | |
| JBT0504 | Ac-FQSKGNVFV-NnmetPhe-GYFERLRAKL-NH2 (SEQ ID NO: 418) | 62 | | | | |
| JBT0505 | Ac-FQSKGNVFVF-NnmetGly-YFERLRAKL-NH2 (SEQ ID NO: 269) | 204 | 90 | | | |
| JBT0508 | Ac-FQSKGNVFVFGYF-NnmetGlu-RLRAKL-NH2 (SEQ ID NO: 678) | 82 | | | | |
| JBT0514 | Ac-FQSKGNVFVFGYFERLRAK-NnmetLeu-NH2 (SEQ ID NO: 419) | 69 | | | | |
| JBT0515 | Ac-bHomoPhe-QSKGNVFVFGYFERLRAKL-NH2 (SEQ ID NO: 420) | 86 | 31 | | | |
| JBT0517 | Ac-FQ-bHomoSer-KGNVFVFGYFERLRAKL-NH2 (SEQ ID NO: 421) | 34 | | | | |
| JBT0518 | Ac-FQS-bHomoLys-GNVFVFGYFERLRAKL-NH2 (SEQ ID NO: 422) | 38 | | | | |
| JBT0519 | Ac-FQSK-bAla-NVFVFGYFERLRAKL-NH2 (SEQ ID NO: 270) | 105 | 37 | | | |
| JBT0520 | Ac-FQSKG-bGln-VFVFGYFERLRAKL-NH2 (SEQ ID NO: 271) | 100 | 42 | | | |

FIG. 28G

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0522 | Ac-FQSKGNV-bHomoPhe-VFGYFERLRAKL-NH2 (SEQ ID NO: 681) | 40 | | | | |
| JBT0524 | Ac-FQSKGNVFV-bHomoPhe-GYFERLRAKL-NH2 (SEQ ID NO: 682) | 36 | | | | |
| JBT0527 | Ac-FQSKGNVFVFGY-bHomoPhe-ERLRAKL-NH2 (SEQ ID NO: 683) | 44 | | | | |
| JBT0528 | Ac-FQSKGNVFVFGYF-bE-RLRAKL-NH2 (SEQ ID NO: 272) | 151 | 100 | | | |
| JBT0531 | Ac-FQSKGNVFVFGYFERL-bHomoArg-AKL-NH2 (SEQ ID NO: 203) | 170 | 99 | | | |
| JBT0532 | Ac-FQSKGNVFVFGYFERLR-bAla-KL-NH2 (SEQ ID NO: 423) | 118 | 53 | | | |
| JBT0533 | Ac-FQSKGNVFVFGYFERLRA-bHomoK-L-NH2 (SEQ ID NO: 424) | 97 | 29 | | | |
| JBT0534 | Ac-FQSKGNVFVFGYFERLRAK-Btl-NH2 (SEQ ID NO: 204) | 156 | 130 | | | |
| JBT0535 | Ac-FQSKGNVFVFGYFE-Cit-LRAKL-NH2 (SEQ ID NO: 685) | 97 | 28 | | | |
| JBT0536 | Ac-FQSKGNVFVFGYFERL-Cit-AKL-NH2 (SEQ ID NO: 273) | 196 | 133 | | | |
| JBT0538 | Ac-FQSKGNVFVFGYFERL-Nle-AKL-NH2 (SEQ ID NO: 425) | 118 | 59 | | | |
| JBT0564 | Ac-FQSKKNVFVFGYFKRLRAKL-NH2 (SEQ ID NO: 205) | 120 | 61 | | | |
| JBT0613 | Ac-FQSKGNVFVFGYFERLRAKL-OH (SEQ ID NO: 283) | 156 | 55 | | | |
| JBT0614 | NH2-FQSKGNVFVFGYFERLRAKL-OH (SEQ ID NO: 720) | 54 | | | | |
| JBT0615 | NH2-FQSKGNVFVFGYFERLRAKL-NH2 (SEQ ID NO: 284) | 105 | 33 | | | |
| JBT0616 | NH2-GSFQSKKNVFVDGYFERLRAKL-OH (SEQ ID NO: 285) | 162 | 77 | | | |
| JBT0616 | NH2-GSFQSKKNVFVDGYFERLRAKL-OH (SEQ ID NO: 285) | 147 | 29 | | | |
| JBT0651 | Ac-FQSKGNVHVKGYFERLRAKL-NH2 (SEQ ID NO: 48) | 250 | 216 | | | |

FIG. 28H

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0652 | Ac-FQSKGNVHVDGYFERLRAKL-NH2 (SEQ ID NO: 49) | | 207 | | | |
| JBT0653 | Ac-FQSPGNVHVKGYFERLRAKL-NH2 (SEQ ID NO: 50) | | 237 | | | |
| JBT0654 | Ac-FQSPGNVHVDGYFERLRAKL-NH2 (SEQ ID NO: 51) | | 214 | | | |
| JBT0655 | Ac-FQSKGNIFVFGYFERLRAKL-NH2 (SEQ ID NO: 52) | 150 | 120 | | | |
| JBT0656 | Ac-FQSKGNLFVFGYFERLRAKL-NH2 (SEQ ID NO: 286) | 86 | 42 | | | |
| JBT0657 | Ac-FQSKGNVFIFGYFERLRAKL-NH2 (SEQ ID NO: 287) | 92 | 47 | | | |
| JBT0663 | Ac-FQSKaNVFVFGYFERLRAKL-NH2 (SEQ ID NO: 53) | | 180 | | | |
| JBT0668 | Ac-FQSKaNVHVTGYFARLRAKL-NH2 (SEQ ID NO: 54) | | 167 | | | |
| JBT0681 | Ac-FQSK-Nmg-AVFVFGYFARLRAKL-NH2 (SEQ ID NO: 206) | | 158 | | | |
| JBT0683 | Ac-FQSK-Nmg-AVFVDGYFARLRAKL-NH2 (SEQ ID NO: 55) | | 228 | | | |
| JBT0696 | Ac-FQSKKAVFVFGYFERLRAKL-NH2 (SEQ ID NO: 288) | 64 | 60 | | | |
| JBT0697 | Ac-FQSKGNVFVDGYFERL-Dap-AKL-NH2 (SEQ ID NO: 56) | | 188 | | | |
| JBT0699 | Ac-FQSKGNVFVDGYFERL-Orn-AKL-NH2 (SEQ ID NO: 57) | | 207 | | | |
| JBT0700 | Ac-FQSKGNVFVDGYFERL-Nva-AKL-NH2 (SEQ ID NO: 58) | | 218 | | | |
| JBT0704 | Ac-FQSKKNVFVFGYFARLRAKL-NH2 (SEQ ID NO: 289) | 96 | 35 | | | |
| JBT0708 | Ac-FQSKaNVFVAGYFARLRAKL-NH2 (SEQ ID NO: 59) | | 200 | | | |
| JBT0714 | Ac-FQSKaAVFVDGYFARLRAKL-NH2 (SEQ ID NO: 60) | | 209 | | | |
| JBT0717 | Ac-FQSK-Nmg-NVFVDGYFERLRAKL-NH2 (SEQ ID NO: 61) | 271 | 241 | 0.11 | | 42.1 |

FIG. 28I

| JBT0047 class | | Thrombin generation assay | | EC₅₀ (µM), FVIII-inhibited plasma | % FVIII-equivalent activity in FVIII deficient plasma @ 10µM peptide | % FVIII-equivalent activity in FVIII deficient plasma @ 1.1µM peptide |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | | | |
| JBT0720 | Ac-FQSK-Nmg-NVFVTGYFARLRAKL-NH2 (SEQ ID NO: 62) | | 271 | | | |
| JBT0732 | Ac-FQSKGNVFVDGYFERL-Hci-AKL-NH2 (SEQ ID NO: 63) | | 258 | | | |
| JBT0733 | Ac-FQSKGNVFVDGYFERL-Har-AKL-NH2 (SEQ ID NO: 64) | | 213 | | | |
| JBT0739 | Ac-FQSKGNVFVDGYFERL-Opa-AKL-NH2 (SEQ ID NO: 65) | | 193 | | | |
| JBT0740 | Ac-FQSKGNVFVDGYFERL-Aib-AKL-NH2 (SEQ ID NO: 66) | 236 | 184 | 0.29 | | 33.3 |
| JBT0754 | Ac-FQSK-Nmg-AVFVTGYFARLRAKL-NH2 (SEQ ID NO: 67) | | 224 | | | |
| JBT0759 | Ac-FQSKkNVFVFGYFERLRAKL-NH2 (SEQ ID NO: 207) | 159 | 131 | | | |
| JBT0765 | Ac-FQSKGNVFVDGYFERL-Eew-AKL-NH2 (SEQ ID NO: 68) | | 205 | | | |
| JBT0775 | Ac-FQSKGNVFVTGYFDRLRAKL-NH2 (SEQ ID NO: 69) | | 157 | | | |
| JBT0778 | Ac-FQSKGNVFVDGYFDRLRAKL-NH2 (SEQ ID NO: 209) | | 176 | | | |
| JBT0779 | Ac-FQSKGNVFVEGYFDRLRAKL-NH2 (SEQ ID NO: 210) | | 145 | | | |
| JBT0780 | Ac-FQSK-Nmg-NVFVFGYFARLRAKL-NH2 (SEQ ID NO: 70) | | 227 | | | |
| JBT0781 | Ac-FQSKGNVFVDGYFKRLRAKL-NH2 (SEQ ID NO: 211) | | 156 | | | |
| JBT0789 | Ac-FQSK-Nmg-NVFVDGYFERL-Nle-AKL-NH2 (SEQ ID NO: 71) | 266 | 230 | 0.26 | | |
| JBT0806 | Ac-FQSK-Nmg-NVFVAGYFARLRAKL-NH2 (SEQ ID NO: 74) | | 281 | | | |
| JBT0837 | Ac-FQSK-Nmg-NVFVTGYFERL-Nle-AKL-NH2 (SEQ ID NO: 213) | | 259 | | | |
| JBT0844 | Ac-FQSKaNVFVDGYFERLRAKL-NH2 (SEQ ID NO: 300) | | 195 | | | |
| JBT0850 | Ac-FQSKaVFVAGYFARLRAKL-NH2 (SEQ ID NO: 302) | | 174 | | | |

FIG. 28J

| JBT0047 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0854 | Ac-FQSKaAVFVAGYFARL-Nle-AKL-NH2 (SEQ ID NO: 490) | | 34 | | | |
| JBT0870 | Ac-FQSKaAVFVTGYFARLRAKL-NH2 (SEQ ID NO: 214) | | 167 | | | |
| JBT0886 | Ac-FQSKaNVFVDGYFARLRAKL-NH2 (SEQ ID NO: 215) | | 186 | | | |
| JBT0919 | Ac-FQSKaNVFVTGYFERLRAKL-NH2 (SEQ ID NO: 79) | | 204 | | | |
| JBT0931 | Ac-FQSKGNVFVDGYFERL-Eag-AKL-NH2 (SEQ ID NO: 82) | | 172 | | | |
| JBT0946 | Ac-FQSKGNVFVDGYFERL-Dab-AKL-NH2 (SEQ ID NO: 85) | | 177 | | | |
| JBT0950 | Ac-FQSKaNVFVFGYFARLRAKL-NH2 (SEQ ID NO: 217) | | 115 | | | |
| JBT0973 | Ac-FQSKGNVFVDGYFERL-Cha-AKL-NH2 (SEQ ID NO: 92) | | 193 | | | |
| JBT1006 | Ac-FQSKGNVFVDGYFERL-Hle-AKL-NH2 (SEQ ID NO: 96) | | 210 | | | |
| JBT1035 | Ac-FQSK-Nmg-AVFVAGYFARL-Nle-AKL-NH2 (SEQ ID NO: 218) | | 172 | | | |
| JBT1037 | Ac-FQSKGNVFVDGYFERL-Nle-AKL-NH2 (SEQ ID NO: 104) | | 192 | | | |
| JBT1043 | Ac-FQSKaNVFVDGYFERL-Nle-AKL-NH2 (SEQ ID NO: 106) | | 203 | | | |
| JBT1082 | Ac-FQSKaAVFVFGYFARLRAKL-NH2 (SEQ ID NO: 565) | | 90 | | | |
| JBT1084 | Ac-FQSK-Nmg-AVFVAGYFARLRAKL-NH2 (SEQ ID NO: 109) | | 192 | | | |
| JBT1122 | Ac-FQSK-Nmg-NVFVDGYFARL-Nle-AKL-NH2 (SEQ ID NO: 113) | | 353 | | | |
| JBT1133 | Ac-FQSKkAVFVDGYFARLRAKL-NH2 (SEQ ID NO: 115) | 233 | 236 | | | |
| JBT1134 | Ac-FQSKGAVFVDGYFARLRAKL-NH2 (SEQ ID NO: 116) | 240 | 204 | | | |
| JBT1135 | Ac-FQSKDAVFVDGYFARLRAKL-NH2 (SEQ ID NO: 221) | 227 | 146 | | | |

FIG. 28K

| JBT0047 class | | Thrombin generation assay | | | | |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | EC$_{50}$ (µM), FVIII-inhibited plasma | % FVIII-equivalent activity in FVIII deficient plasma @ 10µM peptide | % FVIII-equivalent activity in FVIII deficient plasma @ 1.1µM peptide |
| JBT1136 | Ac-FQSKdAVFVDGYFARLRAKL-NH2 (SEQ ID NO: 117) | 283 | 227 | | | |
| JBT1137 | Ac-FQSKkAVFVAGYFARLRAKL-NH2 (SEQ ID NO: 118) | 218 | 231 | | | |
| JBT1138 | Ac-FQSKGAVFVAGYFARLRAKL-NH2 (SEQ ID NO: 222) | 185 | 161 | | | |
| JBT1139 | Ac-FQSKDAVFVAGYFARLRAKL-NH2 (SEQ ID NO: 223) | 205 | 146 | | | |
| JBT1140 | Ac-FQSKdAVFVAGYFARLRAKL-NH2 (SEQ ID NO: 119) | 203 | 124 | | | |
| JBT1141 | Ac-FQSKkAVFVKGYFARLRAKL-NH2 (SEQ ID NO: 120) | 223 | 217 | 0.12 | | |
| JBT1142 | Ac-FQSKGAVFVKGYFARLRAKL-NH2 (SEQ ID NO: 224) | 299 | 233 | | | |
| JBT1143 | Ac-FQSKDAVFVKGYFARLRAKL-NH2 (SEQ ID NO: 225) | 214 | 170 | | | |
| JBT1144 | Ac-FQSKdAVFVKGYFARLRAKL-NH2 (SEQ ID NO: 121) | 200 | 164 | 0.21 | | |
| JBT1145 | Ac-FQSKkAVFVTGYFARLRAKL-NH2 (SEQ ID NO: 122) | 274 | 243 | | | |
| JBT1146 | Ac-FQSKGAVFVTGYFARLRAKL-NH2 (SEQ ID NO: 226) | 231 | 185 | | | |
| JBT1147 | Ac-FQSKDAVFVTGYFARLRAKL-NH2 (SEQ ID NO: 227) | 230 | 146 | | | |
| JBT1148 | Ac-FQSKdAVFVTGYFARLRAKL-NH2 (SEQ ID NO: 123) | 231 | 185 | | | |
| JBT1151 | Ac-FQSKKNVFVFGYFARLRAKD-NH2 (SEQ ID NO: 937) | 27 | | | | |
| JBT1153 | Ac-FQSKKNVFVFGYFERLGAKL-NH2 (SEQ ID NO: 705) | 125 | 45 | | | |
| JBT1155 | Ac-FQSK-Nmg-NVFVTGYFERLRAKL-NH2 (SEQ ID NO: 125) | | 258 | | | |
| JBT1156 | Ac-FQSKaNVFVDGYFARL-Nle-AKL-NH2 (SEQ ID NO: 126) | | 173 | | | |
| JBT1157 | Ac-FQSKaNVFVAGYFARLRAKL-NH2 (SEQ ID NO: 127) | | 178 | | | |

FIG. 28L

JBT0047 class

| Peptide | Sequence | Thrombin generation assay | | | | |
|---|---|---|---|---|---|---|
| | | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT1584 | Ac-FQSK-Nnng-NVFVDGYFERL-Aib-AKL-NH2 (SEQ ID NO: 164) | 330 | 301 | 0.16 | | 48.6 |
| JBT1585 | Ac-FQSK-Nnng-NVFVTGYFERL-Aib-AKL-NH2 (SEQ ID NO: 165) | 300 | 269 | 0.13 | | |
| JBT1587 | Ac-FQSKGNVFVDGYFERL-Aib-AKLC-NH2 (SEQ ID NO: 167) | | 189 | 0.32 | | |
| JBT1590 | Ac-FQSKGNVFV[CGYFERL-Aib-AKLC]-NH2 (SEQ ID NO: 401) | 35 | | | | |
| JBT1591 | Ac-FQSKGNVFVDGYF[CRL-Aib-AKLC]-NH2 (SEQ ID NO: 168) | 148 | 75 | | | |
| JBT1592 | Ac-[CFQSKGNVFVDGYFERLC]AKL-NH2 (SEQ ID NO: 402) | 138 | 46 | | | |
| JBT1593 | Ac-FQSK[CNVFVDGYFERLC]AKL-NH2 (SEQ ID NO: 670) | 110 | 39 | | | |
| JBT1594 | Ac-FQSKGNVFV[CGYFERLC]AKL-NH2 (SEQ ID NO: 671) | 35 | | | | |
| JBT1595 | Ac-[CFQSKGC]VFVEGYFERL-Aib-AKL-NH2 (SEQ ID NO: 403) | 82 | 22 | | | |
| JBT1596 | Ac-[CFQSKGC]VFVDGYFERL-Aib-AKL-NH2 (SEQ ID NO: 404) | 116 | 36 | | | |
| JBT1853 | PEG(40kD)-FQSKGNVFVDGYFERL-Aib-AKL-NH2 (SEQ ID NO: 175) | | 605 | | | |
| JBT1855 | Ac-FQSKGNVFVDGYFERL-Aib-AKLC(PEG40kD)-NH2 (SEQ ID NO: 252) | | 642 | | | |

FIG. 29A

| JBT0120 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0120 | Ac-SGASRYKWF[CGMRDMKGTMSC]VWVKFRYDTS-NH2 (SEQ ID NO: 1047) | 269 | 95 | 2.78 | 28.8 | 8.6 |
| JBT0247 | Ac-SGASRYKWFCGMRDMKGTMSCVWVKFRYDTS-NH2 (SEQ ID NO: 1213) | 273 | | | | |
| JBT0248 | Ac-KKSGASRYKWF[CGMRDMKGTMSC]VWVKFRYDTSKK-NH2 (SEQ ID NO: 1001) | 164 | | | | |
| JBT0319 | Ac-SGASRYKWF[CGMRDMKGTMSC]VWVKFRY-NH2 (SEQ ID NO: 1075) | 383 | 187 | | 29.3 | |
| JBT0320 | Ac-SGASRYKWF[CGMRDMKGTMSC]VWVKK-NH2 (SEQ ID NO: 1103) | 153 | 21 | | | |
| JBT0323 | Ac-SRYKWF[CGMRDMKGTMSC]VWVKFRYDTS-NH2 (SEQ ID NO: 1076) | 355 | 142 | | 31.4 | |
| JBT0324 | Ac-KWF[CGMRDMKGTMSC]VWVKFRYDTS-NH2 (SEQ ID NO: 1155) | 91 | | | | |
| JBT0329 | Ac-KWF[CGMRDMKGTMSC]VWVKF-NH2 (SEQ ID NO: 1156) | 70 | | | 6.6 | |
| JBT0333 | Ac-KWFCGMRDMKGTMSCVWVKF-NH2 (SEQ ID NO: 1207) | 40 | | | | |
| JBT0333 | Ac-KWFCGMRDMKGTMSCVWVKF-NH2 (SEQ ID NO: 1207) | 114 | | | | |
| JBT0411 | Ac-SGASRYKWF[CG-Nle-RD-Nle-KGT-Nle-SC]VWVKFRYDTS-NH2 (SEQ ID NO: 1104) | 97 | | | | |
| JBT0412 | Ac-KWF[CG-Nle-RD-Nle-KGT-Nle-SC]VWVKF-NH2 (SEQ ID NO: 1209) | 46 | | | | |
| JBT0415 | Ac-SRYKWF[CGMRDMKGTMSC]VWVKF-NH2 (SEQ ID NO: 1003) | 291 | 182 | 0.57 | 47.2 | 36.5 |
| JBT0416 | Ac-SRYKWF[CG-Nle-RD-Nle-KGT-Nle-SC]VWVKF-NH2 (SEQ ID NO: | 256 | 95 | | 36.6 | 22.3 |

FIG. 29B

| JBT0120 class | | Thrombin generation assay | | | | |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | EC$_{50}$ (µM), FVIII-inhibited plasma | % FVIII-equivalent activity in FVIII deficient plasma @ 10µM peptide | % FVIII-equivalent activity in FVIII deficient plasma @ 1.1µM peptide |
| | (1077) | | | | | |
| JBT0437 | Ac-ARYKWF[CGMRDMKGTMSC]VWVKF-NH2 (SEQ ID NO: 1048) | 362 | 225 | | | |
| JBT0438 | Ac-SAYKWF[CGMRDMKGTMSC]VWVKF-NH2 (SEQ ID NO: 1078) | 300 | 137 | | | |
| JBT0439 | Ac-SRAKWF[CGMRDMKGTMSC]VWVKF-NH2 (SEQ ID NO: 1105) | 266 | 88 | | | |
| JBT0440 | Ac-SRYAWF[CGMRDMKGTMSC]VWVKF-NH2 (SEQ ID NO: 1106) | 175 | 33 | | | |
| JBT0441 | Ac-SRYKAF[CGMRDMKGTMSC]VWVKF-NH2 (SEQ ID NO: 1230) | 18 | 5 | | | |
| JBT0442 | Ac-SRYKWA[CGMRDMKGTMSC]VWVKF-NH2 (SEQ ID NO: 1231) | 53 | 8 | | | |
| JBT0444 | Ac-SRYKWF[CAMRDMKGTMSC]VWVKF-NH2 (SEQ ID NO: 1004) | 331 | 229 | 0.42 | 53.4 | 45.7 |
| JBT0445 | Ac-SRYKWF[CGARDMKGTMSC]VWVKF-NH2 (SEQ ID NO: 1107) | 157 | 40 | | | |
| JBT0446 | Ac-SRYKWF[CGMADMKGTMSC]VWVKF-NH2 (SEQ ID NO: 1079) | 287 | 140 | | | |
| JBT0447 | Ac-SRYKWF[CGMRAMKGTMSC]VWVKF-NH2 (SEQ ID NO: 1158) | 101 | | | | |
| JBT0448 | Ac-SRYKWF[CGMRDAKGTMSC]VWVKF-NH2 (SEQ ID NO: 1108) | 324 | 138 | | | |
| JBT0449 | Ac-SRYKWF[CGMRDMAGTMSC]VWVKF-NH2 (SEQ ID NO: 1080) | 362 | 217 | | 54.1 | 34.2 |
| JBT0450 | Ac-SRYKWF[CGMRDMKATMSC]VWVKF-NH2 (SEQ ID NO: 1159) | 232 | 68 | | | |
| JBT0451 | Ac-SRYKWF[CGMRDMKGAMSC]VWVKF-NH2 (SEQ ID NO: 1081) | 339 | 189 | | | |
| JBT0452 | Ac-SRYKWF[CGMRDMKGTASC]VWVKF-NH2 (SEQ ID NO: 1109) | 265 | 119 | | | |
| JBT0453 | Ac-SRYKWF[CGMRDMKGTMAC]VWVKF-NH2 (SEQ ID NO: 1110) | 282 | 111 | | | |
| JBT0455 | Ac-SRYKWF[CGMRDMKGTMSC]AWVKF-NH2 (SEQ ID NO: 1049) | 316 | 203 | | | |

FIG. 29C

| JBT0120 class | | Thrombin generation assay | | EC$_{50}$ (µM), FVIII-inhibited plasma | % FVIII-equivalent activity in FVIII deficient plasma @ 10µM peptide | % FVIII-equivalent activity in FVIII deficient plasma @ 1.1µM peptide |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | | | |
| JBT0456 | Ac-SRYKWF[CGMRDMKGTMSC]VAVKF-NH2 (SEQ ID NO: 1232) | 16 | | | | |
| JBT0457 | Ac-SRYKWF[CGMRDMKGTMSC]VWAKF-NH2 (SEQ ID NO: 1161) | 76 | | | | |
| JBT0458 | Ac-SRYKWF[CGMRDMKGTMSC]VWVAF-NH2 (SEQ ID NO: 1082) | 292 | 161 | | | |
| JBT0459 | Ac-SRYKWF[CGMRDMKGTMSC]VWVKA-NH2 (SEQ ID NO: 1083) | 266 | 137 | | | |
| JBT0460 | Ac-RYKWF[CGMRDMKGTMSC]VWVKF-NH2 (SEQ ID NO: 1050) | 262 | 138 | | | |
| JBT0461 | Ac-YKWF[CGMRDMKGTMSC]VWVKF-NH2 (SEQ ID NO: 1111) | 197 | 47 | | | |
| JBT0625 | Ac-SRYKWF[CMRDMKGTMSC]VWVKF-NH2 (SEQ ID NO: 1244) | 5 | 3 | | | |
| JBT0626 | Ac-SRYKWF[CGMRDKGTMSC]VWVKF-NH2 (SEQ ID NO: 1164) | 81 | 10 | | | |
| JBT0627 | Ac-SRYKWF[CGMRDMGTMSC]VWVKF-NH2 (SEQ ID NO: 1165) | 62 | 15 | | | |
| JBT0628 | Ac-SRYKWF[CGMRDMKGMSC]VWVKF-NH2 (SEQ ID NO: 1166) | 54 | 16 | | | |
| JBT0631 | Ac-SRYKWF[CGmRDMKGTMSC]VWVKF-NH2 (SEQ ID NO: 1113) | 171 | 60 | | | |
| JBT0634 | Ac-SRYKWF[CGMRDmKGTMSC]VWVKF-NH2 (SEQ ID NO: 1051) | 311 | 156 | | | |
| JBT0635 | Ac-SRYKWF[CGMRDMKGTMSC]VWVKF-NH2 (SEQ ID NO: 1114) | 123 | | | | |
| JBT0641 | Ac-SRYKWF[CPMRDMKGTMSC]VWVKF-NH2 (SEQ ID NO: 1247) | 21 | | | | |
| JBT0642 | Ac-SRYKWF[CGPRDMKGTMSC]VWVKF-NH2 (SEQ ID NO: 1248) | 32 | | | | |
| JBT0643 | Ac-SRYKWF[CGMPDMKGTMSC]VWVKF-NH2 (SEQ ID NO: 1006) | 289 | 192 | 0.63 | | |
| JBT0644 | Ac-SRYKWF[CGMRPMKGTMSC]VWVKF-NH2 (SEQ ID NO: 1172) | 31 | | | | |
| JBT0645 | Ac-SRYKWF[CGMRDPKGTMSC]VWVKF-NH2 (SEQ ID NO: 1084) | 31 | 109 | | | |

FIG. 29D

| JBT0120 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0646 | Ac-SRYKWF[CGMRDMPGTMSC]VWVKF-NH2 (SEQ ID NO: 1173) | 84 | | | | |
| JBT0648 | Ac-SRYKWF[CGMRDMKGPMSC]VWVKF-NH2 (SEQ ID NO: 1174) | 42 | | | | |
| JBT0649 | Ac-SRYKWF[CGMRDMKGTPSC]VWVKF-NH2 (SEQ ID NO: 1175) | 64 | | | | |
| JBT1416 | Ac-DRYKWF[CGMRDMKGTMSC]VWVKF-NH2 (SEQ ID NO: 1007) | 253 | 102 | 1.38 | | |
| JBT1417 | Ac-SDYKWF[CGMRDMKGTMSC]VWVKF-NH2 (SEQ ID NO: 1116) | 140 | 30 | 4.79 | | |
| JBT1418 | Ac-SRDKWF[CGMRDMKGTMSC]VWVKF-NH2 (SEQ ID NO: 1176) | 67 | | 3.15 | | |
| JBT1419 | Ac-SRYDWF[CGMRDMDGTMSC]VWVKF-NH2 (SEQ ID NO: 1117) | 120 | | 3.80 | | |
| JBT1426 | Ac-SRYKWF[CGMRDMKGTMSC]VWVKF-NH2 (SEQ ID NO: 1008) | 287 | 135 | 0.94 | | |
| JBT1436 | Ac-FRYKWF[CGMRDMKGTMSC]VWVKF-NH2 (SEQ ID NO: 1053) | 228 | 72 | 2.54 | | |
| JBT1437 | Ac-SFYKWF[CGMRDMKGTMSC]VWVKF-NH2 (SEQ ID NO: 1010) | 284 | 157 | 0.85 | | |
| JBT1438 | Ac-SRFKWF[CGMRDFKGTMSC]VWVKF-NH2 (SEQ ID NO: 1011) | 218 | 81 | 1.63 | | |
| JBT1445 | Ac-SRYKWF[CGMRDMFGTMSC]VWVKF-NH2 (SEQ ID NO: 1012) | 213 | 89 | 1.75 | | |
| JBT1446 | Ac-SRYKWF[CGMRDMKGFMSC]VWVKF-NH2 (SEQ ID NO: 1054) | 169 | 64 | 1.53 | | |
| JBT1448 | Ac-SRYKWF[CGMRDMKGTFSC]VWVKF-NH2 (SEQ ID NO: 1123) | 184 | 34 | | | |
| JBT1449 | Ac-SRYKWF[CGMRDMKGTFSC]VWVKF-NH2 (SEQ ID NO: 1013) | 276 | 116 | 1.45 | | |
| JBT1455 | Ac-GRYKWF[CGMRDMKGTMSC]VWVKF-NH2 (SEQ ID NO: 1014) | 226 | 66 | 2.50 | | |
| JBT1465 | Ac-SRYKWF[CGMRDMGGTMSC]VWVKF-NH2 (SEQ ID NO: 1015) | 235 | 74 | 2.46 | | |
| JBT1474 | Ac-KRYKWF[CGMRDMKGTMSC]VWVKF-NH2 (SEQ ID NO: 1016) | 275 | 136 | 1.06 | | |

FIG. 29E

| JBT0120 class | | Thrombin generation assay | | | % FVIII-equivalent activity in FVIII deficient plasma @ 10μM peptide | % FVIII-equivalent activity in FVIII deficient plasma @ 1.1μM peptide |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | | |
| JBT1481 | Ac-SRYKWF[CGMRKDMKGTMSC]VWVKF-NH2 (SEQ ID NO: 1017) | 303 | 123 | 1.48 | | |
| JBT1483 | Ac-SRYKWF[CGMRDKKGTMSC]VWVKF-NH2 (SEQ ID NO: 1057) | 275 | 88 | | | |
| JBT1492 | Ac-LRYKWF[CGMRDMKGTMSC]VWVKF-NH2 (SEQ ID NO: 1018) | 239 | 100 | 1.55 | | |
| JBT1493 | Ac-SLYKWF[CGMRDMKGTMSC]VWVKF-NH2 (SEQ ID NO: 1060) | 261 | 122 | 1.17 | | |
| JBT1502 | Ac-SRYKWF[CGMRDLKGTMSC]VWVKF-NH2 (SEQ ID NO: 1019) | 307 | 175 | 0.77 | | |
| JBT1503 | Ac-SRYKWF[CGMRDMLGTMSC]VWVKF-NH2 (SEQ ID NO: 1063) | 202 | 105 | 0.95 | | |
| JBT1506 | Ac-SRYKWF[CGMRDMKGTLSC]VWVKF-NH2 (SEQ ID NO: 1064) | 191 | 49 | 2.99 | | |
| JBT1512 | Ac-SRYKWF[CGMRDMKGTMSC]VWVKL-NH2 (SEQ ID NO: 1020) | 294 | 152 | 0.89 | | |
| JBT1523 | Ac-SRYKWF[CGMRDMSGTMSC]VWVKF-NH2 (SEQ ID NO: 1022) | 255 | 115 | 1.30 | | |
| JBT1541 | Ac-SRYKWF[CGMRDMKGTMSC]VWVPF-NH2 (SEQ ID NO: 1023) | 291 | 155 | 0.82 | | |
| JBT1543 | Ac-SRYKWF[CGMRDMKGTMSC]VWVKF-OH (SEQ ID NO: 1098) | 192 | 39 | 3.10 | | |
| JBT1544 | H-SRYKWF[CGMRDMKGTMSC]VWVKF-NH2 (SEQ ID NO: 1024) | 235 | 98 | | | |
| JBT1545 | H-SRYKWF[CGMRDMKGTMSC]VWVKF-OH (SEQ ID NO: 1099) | 152 | 21 | 7.92 | | |
| JBT1557 | H-RYKWF[CGMRDMKGTMSC]VWVKF-NH2 (SEQ ID NO: 173) | 208 | 91 | | | |
| JBT1558 | H-YKWF[CGMRDMKGTMSC]VWVKF-NH2 (SEQ ID NO: 1149) | 115 | 20 | | | |
| JBT1559 | Ac-SRYKWF[CGaRDMKGTMSC]VWVKF-NH2 (SEQ ID NO: 1150) | 131 | 42 | | | |
| JBT1562 | Ac-SRYKWF[CGkRDMKGTMSC]VWVKF-NH2 (SEQ ID NO: 1193) | 54 | | | | |
| JBT1567 | Ac-SRYKWF[CGMRDdKGTMSC]VWVKF-NH2 (SEQ ID NO: 1101) | 226 | 76 | | | |

FIG. 29F

| JBT0120 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT1570 | Ac-SRYKWF[CGMRDIKGTMSC]VWVKF-NH2 (SEQ ID NO: 1025) | 250 | 76 | | | |
| JBT1574 | Ac-SRYKWF[CGMRDMdGTMSC]VWVKF-NH2 (SEQ ID NO: 1153) | 173 | 34 | | | |

FIG. 30A

JBT0122 class

| Peptide | Sequence | Thrombin generation assay FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
|---|---|---|---|---|---|---|
| JBT0122 | AC-SGYASFPLAVQLHVSKRSKEMALARLYYKTS-NH2 (SEQ ID NO: 2002) | 170 | 31 | | 160 | |
| JBT0221 | Ac-KKSGYASFPLAVQLHVSKRSKEMALARLYYKTSKK-NH2 (SEQ ID NO: 2003) | 206 | 150 | | | |
| JBT0224 | Ac-KKSGYASFPLAVQLHVSKRSKEMALARLYYKK-NH2 (SEQ ID NO: 2298) | 152 | 58 | 1.10 | 162 | |
| JBT0225 | Ac-KKSGYASFPLAVQLHVSKRSKEMALARKK-NH2 (SEQ ID NO: 2128) | 55 | | | | |
| JBT0367 | Ac-ASFPLAVQLHVSKRSKEMALARL-NH2 (SEQ ID NO: 2317) | 28 | | | | |
| JBT0368 | Ac-ASFPLAVQLHVSKRSKEMALARLY-NH2 (SEQ ID NO: 2130) | 36 | | | | |
| JBT0369 | Ac-ASFPLAVQLHVSKRSKEMALARLYY-NH2 (SEQ ID NO: 2017) | 68 | | | | |
| JBT0370 | Ac-YASFPLAVQLHVSKRSKEMA-NH2 (SEQ ID NO: 2318) | 39 | | | | |
| JBT0371 | Ac-GYASFPLAVQLHVSKRSKEMA-NH2 (SEQ ID NO: 2319) | 25 | | | | |
| JBT0660 | Ac-AGYASFPLAVQLHVSKRSKEMALARLYYKTS-NH2 (SEQ ID NO: 2004) | 141 | 27 | | | |
| JBT0661 | Ac-SAYASFPLAVQLHVSKRSKEMALARLYYKTS-NH2 (SEQ ID NO: 2005) | 215 | 49 | | | |
| JBT0662 | Ac-SGAASFPLAVQLHVSKRSKEMALARLYYKTS-NH2 (SEQ ID NO: 2131) | 43 | | | | |

FIG. 30B

| JBT0122 class | | Thrombin generation assay | | | | |
|---|---|---|---|---|---|---|
| Peptide | Sequence | FEIBA-equivalent activity in FVIII-inhibited plasma @ 10µM peptide [mU/mL] | FEIBA-equivalent activity in FVIII-inhibited plasma @ 1.1µM peptide [mU/mL] | EC$_{50}$ (µM), FVIII-inhibited plasma | % FVIII-equivalent activity in FVIII deficient plasma @ 10µM peptide | % FVIII-equivalent activity in FVIII deficient plasma @ 1.1µM peptide |
| JBT0664 | Ac-SGYAAFPLAVQLHVSKRSKEMALARLYYKTS-NH2 (SEQ ID NO: 2006) | 178 | 26 | | | |
| JBT0665 | Ac-SGYASAPLAVQLHVSKRSKEMALARLYYKTS-NH2 (SEQ ID NO: 2132) | 49 | | | | |
| JBT0666 | Ac-SGYASFALAVQLHVSKRSKEMALARLYYKTS-NH2 (SEQ ID NO: 2001) | 99 | 23 | | | |
| JBT0667 | Ac-SGYASFPAAVQLHVSKRSKEMALARLYYKTS-NH2 (SEQ ID NO: 2018) | 95 | | | | |
| JBT0669 | Ac-SGYASFPLAAQLHVSKRSKEMALARLYYKTS-NH2 (SEQ ID NO: 2133) | 20 | | | | |
| JBT0670 | Ac-SGYASFPLAVALHVSKRSKEMALARLYYKTS-NH2 (SEQ ID NO: 2007) | 101 | | | | |
| JBT0671 | Ac-SGYASFPLAVQAHVSKRSKEMALARLYYKTS-NH2 (SEQ ID NO: 2019) | 120 | | | | |
| JBT0673 | Ac-SGYASFPLAVQLHASKRSKEMALARLYYKTS-NH2 (SEQ ID NO: 2135) | 39 | | | | |
| JBT0674 | Ac-SGYASFPLAVQLHVAKRSKEMALARLYYKTS-NH2 (SEQ ID NO: 2008) | 234 | 90 | | | |
| JBT0675 | Ac-SGYASFPLAVQLHVSARSKEMALARLYYKTS-NH2 (SEQ ID NO: 2008) | 20 | | | | |

FIG. 30C

| JBT0122 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC₅₀ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0677 | Ac-SGYASFPLAVQLHVSKRAKEMALARLYYKTS-NH2 (SEQ ID NO: 2136) | 178 | 37 | | | |
| JBT0678 | Ac-SGYASFPLAVQLHVSKRSAEMALARLYYKTS-NH2 (SEQ ID NO: 2009) | 153 | 23 | | | |
| JBT0679 | Ac-SGYASFPLAVQLHVSKRSKAMALARLYYKTS-NH2 (SEQ ID NO: 2010) | 20 | | | | |
| JBT0682 | Ac-SGYASFPLAVQLHVSKRSKEMAAARLYYKTS-NH2 (SEQ ID NO: 2020) | 133 | 27 | | | |
| JBT0684 | Ac-SGYASFPLAVQLHVSKRSKEMALAALYYKTS-NH2 (SEQ ID NO: 2139) | 159 | 28 | | | |
| JBT0685 | Ac-SGYASFPLAVQLHVSKRSKEMALARAYYKTS-NH2 (SEQ ID NO: 2011) | 131 | 21 | | | |
| JBT0686 | Ac-SGYASFPLAVQLHVSKRSKEMALARLAYKTS-NH2 (SEQ ID NO: 2021) | 109 | | | | |
| JBT0687 | Ac-SGYASFPLAVQLHVSKRSKEMALARLYAKTS-NH2 (SEQ ID NO: 2140) | 124 | | | | |
| JBT0688 | Ac-SGYASFPLAVQLHVSKRSKEMALARLYYATS-NH2 (SEQ ID NO: 2141) | 148 | 29 | | | |
| | (SEQ ID NO: 2012) | | | | | |

FIG. 30D

| JBT0122 class | | Thrombin generation assay | | | | |
|---|---|---|---|---|---|---|
| Peptide | Sequence | FEIBA-equivalent activity in FVIII-inhibited plasma @ 10μM peptide [mU/mL] | FEIBA-equivalent activity in FVIII-inhibited plasma @ 1.1μM peptide [mU/mL] | EC$_{50}$ (μM), FVIII-inhibited plasma | % FVIII-equivalent activity in FVIII deficient plasma @ 10μM peptide | % FVIII-equivalent activity in FVIII deficient plasma @ 1.1μM peptide |
| JBT0689 | Ac-SGYASFPLAVQLHVSKRSKEMALARLYYKAS-NH2 (SEQ ID NO: 2013) | 184 | 40 | | | |
| JBT0690 | Ac-SGYASFPLAVQLHVSKRSKEMALARLYYKTA-NH2 (SEQ ID NO: 2014) | 187 | 41 | | | |
| JBT1579 | Ac-GYASFPLAVQLHVAKRSKEMA-NH2 (SEQ ID NO: 2015) | 66 | | | | |
| JBT1581 | Ac-GYASFALAVQLHVAKRSKEMA-NH2 (SEQ ID NO: 2321) | 67 | | | | |
| JBT1582 | Ac-GYASFPLAVQLHVMKRSKEMA-NH2 (SEQ ID NO: 2022) | 73 | | | | |
| JBT1583 | Ac-GYASFALAVQLHVMKRSKEMA-NH2 (SEQ ID NO: 2322) | 68 | | | | |

FIG. 32A

| Object ID | % Inhibition (relative to JBT-0477) | IC50 Mean (nM) | Affinity Class | Sequence | SEQ ID NO: |
|---|---|---|---|---|---|
| JBT0047 | | 115 | C | Ac-SGVGRLQVAFQSKKNVFVFGYFERLRAKLTS-NH2 | 253 |
| JBT0155 | | 30 | A | Ac-KKSGVGRLQVAFQSKKNVFVFGYFERLRAKLTSKK-NH2 | 8 |
| JBT0156* | | >4170 | | Ac-VVEKLTFVQLSFLNRRFSQYAGFKGAGKV-NH2 | 742 |
| JBT0157* | | >4170 | | Ac-RVFLYFSGKAGGLVKLVERQAFQTNVSKFR-NH2 | 743 |
| JBT0158 | | 41 | A | Ac-KKSGVGRLQVAFQSKKNVFVFGYFERLRAKKK-NH2 | 9 |
| JBT0159 | | >8300 | | Ac-KKSGVGRLQVAFQSKKNVFVFGYFERLKK-NH2 | 744 |
| JBT0160 | | >8300 | | Ac-KKSGVGRLQVAFQSKKNVFVFGYFKK-NH2 | 745 |
| JBT0161 | | >8300 | | Ac-KKSGVGRLQVAFQSKKKNVFVFKK-NH2 | 746 |
| JBT0162 | | 36 | A | Ac-KKGRLQVAFQSKKNVFVFGYFERLRAKLTSKK-NH2 | 10 |
| JBT0163 | | 18 | A | Ac-KKQVAFQSKKNVFVFGYFERLRAKLTSKK-NH2 | 11 |
| JBT0164 | | 43 | A | Ac-KKFQSKKNVFVFGYFERLRAKLTSKK-NH2 | 12 |
| JBT0165 | | 6134 | F | Ac-KKKKNVFVFGYFERLRAKLTSKK-NH2 | 712 |
| JBT0169 | | 120 | C | Ac-KKAFQSKKNVFVFGYFERLRAKKK-NH2 | 254 |
| JBT0170 | | 39 | A | Ac-KKFQSKKNVFVFGYFERLRAKLKK-NH2 | 13 |
| JBT0171 | | 123 | C | Ac-KKQSKKNVFVFGYFERLRAKLTKK-NH2 | 255 |
| JBT0172 | | 295 | D | Ac-KKQSKKNVFVFGYFERLRAKKK-NH2 | 406 |
| JBT0174 | | 44 | A | Ac-KKAFQSKKNVFVFGYFERLRAKLKK-NH2 | 14 |
| JBT0175 | | 65 | B | Ac-KKAFQSKKNVFVFGYFERLRAKLTKK-NH2 | 182 |
| JBT0291 | | 46 | A | Ac-K(FAM)KSGVGRLQVAFQSKKKNVFVFGYFERLRAKLTSKK-NH2 | 15 |
| JBT0293 | 61 | 179 | C | Ac-FQSKKNVFVFGYFERLRAKL-NH2 | 256 |
| JBT0294 | | 188 | C | Ac-YQSKKNVFVFGYFERLRAKL-NH2 | 257 |
| JBT0295 | 37 | 2777 | F | Ac-FSSKKNVFVFGYFERLRAKL-NH2 | 713 |
| JBT0296 | | 575 | D | Ac-FQNKKNVFVFGYFERLRAKL-NH2 | 407 |
| JBT0297 | | 63 | B | Ac-FQSKNNVFVFGYFERLRAKL-NH2 | 183 |
| JBT0298 | | >206 | | Ac-FQSKQNVFVFGYFERLRAKL-NH2 | 747 |
| JBT0299 | 25 | 446 | D | Ac-FQSKKNVFAFGYFERLRAKL-NH2 | 408 |

FIG. 32B

| Object ID | % Inhibition (relative to JBT-0477) | IC50 Mean (nM) | Affinity Class | Sequence | SEQ ID NO: |
|---|---|---|---|---|---|
| JBT0300 | | 943 | D | Ac-FQSKKNVFSFGYFERLRAKL-NH2 | 409 |
| JBT0301 | | 671 | D | Ac-FQSKKKNVFTFGYFERLRAKL-NH2 | 410 |
| JBT0302 | 55 | 133 | C | Ac-FQSKKNVFVAGYFERLRAKL-NH2 | 258 |
| JBT0303 | 66 | 85 | B | Ac-FQSKKNVFVDGYFERLRAKL-NH2 | 184 |
| JBT0304 | 54 | 231 | C | Ac-FQSKKNVFVLGYFERLRAKL-NH2 | 259 |
| JBT0305 | | 154 | C | Ac-FQSKKNVFVQGYFERLRAKL-NH2 | 260 |
| JBT0306 | 50 | 89 | B | Ac-FQSKKNVFVSGYFERLRAKL-NH2 | 185 |
| JBT0307 | | 108 | C | Ac-FQSKKNVFVYGYFERLRAKL-NH2 | 261 |
| JBT0308 | | 736 | D | Ac-FQSKKNVFVFGYKERLRAKL-NH2 | 411 |
| JBT0309 | | 565 | D | Ac-FQSKKNVFVFGYYERLRAKL-NH2 | 412 |
| JBT0310 | 66 | 146 | C | Ac-FQSKKNVFVFGYFDRLRAKL-NH2 | 262 |
| JBT0311 | | >50000 | | Ac-FQSKKNVFVFGYFERLRAKN-NH2 | 748 |
| JBT0335 | | >50000 | | Ac-FQSKNNVFVFGYFERLRAK-NH2 | 749 |
| JBT0336 | | 232 | C | Ac-FQSKNNVFVAGYFDRLRAK-OH | 263 |
| JBT0337 | | 32 | A | Ac-FQSKNNVFVDGYFDRLRAKL-NH2 | 16 |
| JBT0338 | | 32 | A | Ac-FQSKNNVFVQGYFDRLRAKL-NH2 | 17 |
| JBT0339 | | 46 | A | Ac-FQSKNNVFVSGYFDRLRAKL-NH2 | 18 |
| JBT0340 | | 68 | B | Ac-FQSKNNVFVYGYFDRLRAKL-NH2 | 186 |
| JBT0341 | | 75 | B | Ac-FQSKNNVFVDGYFDRLRAKL-NH2 | 187 |
| JBT0342 | 90 | 47 | A | Ac-FQSKNNVFVDGYFDRLRAKL-NH2 | 19 |
| JBT0343 | | 83 | B | Ac-FQSKNNVFVDGYFDRLRAKL-NH2 | 188 |
| JBT0372 | | 313 | D | Fam-Tds-AFQSKKNVFVFGYFERLRAK-NH2 | 413 |
| JBT0373 | | 97 | B | Fam-AFQSKKNVFVFGYFERLRAK-NH2 | 189 |
| JBT0374 | | 25 | A | Ac-FQSKDNVFVFGYFERLRAKL-NH2 | 20 |
| JBT0375 | 101 | 56 | B | Ac-FQSKGNVFVFGYFERLRAKL-NH2 | 190 |
| JBT0376 | 32 | 254 | D | Ac-FQSKKNAFVFGYFERLRAKL-NH2 | 414 |
| JBT0377 | | 146 | C | Ac-FQSKKNQFVFGYFERLRAKL-NH2 | 264 |

FIG. 32C

| Object ID | % Inhibition (relative to JBT-0477) | IC50 Mean [nM] | Affinity Class | Sequence | SEQ ID NO: |
|---|---|---|---|---|---|
| JBT0378 | | 39 | A | Ac-FQSKKNVFVEGYFERLRAKL-NH2 | 21 |
| JBT0379 | | 27 | A | Ac-FQSKKNVFVTGYFERLRAKL-NH2 | 22 |
| JBT0380 | | 81 | B | Ac-FQSKKNVFVVGYFERLRAKL-NH2 | 191 |
| JBT0381 | 40 | 154 | C | Ac-FQSPKNVFVFGYFERLRAKL-NH2 | 265 |
| JBT0385 | | 1765 | E | Ac-FQSKKNNFVFGYFERLRAKL-NH2 | 672 |
| JBT0386 | 42 | 526 | D | Ac-FQSKKNPFVFGYFERLRAKL-NH2 | 415 |
| JBT0388 | | 51 | B | Ac-FQSKKNVHVFGYFERLRAKL-NH2 | 192 |
| JBT0389 | | 1165 | E | Ac-FQSKKNVVVFGYFERLRAKL-NH2 | 673 |
| JBT0390 | | 1393 | E | Ac-FQSKKNVFQFGYFERLRAKL-NH2 | 674 |
| JBT0391 | 22 | 107 | C | Ac-FQSKKNVFVGGYFERLRAKL-NH2 | 266 |
| JBT0392 | | 32 | A | Ac-FQSKKNVFVHGYFERLRAKL-NH2 | 23 |
| JBT0393 | 87 | 56 | B | Ac-FQSKKNVFVKGYFERLRAKL-NH2 | 193 |
| JBT0394 | | 48 | A | Ac-FQSKKNVFVMGYFERLRAKL-NH2 | 24 |
| JBT0395 | | 31 | A | Ac-FQSKKNVFVNGYFERLRAKL-NH2 | 25 |
| JBT0396 | 28 | 80 | B | Ac-FQSKKNVFVPGYFERLRAKL-NH2 | 194 |
| JBT0397 | | 69 | B | Ac-FQSKKNVFVRGYFERLRAKL-NH2 | 195 |
| JBT0398 | | 69 | B | Ac-FQSKKNVFVFGYFEELRAKL-NH2 | 196 |
| JBT0399 | -24 | >185 >5000.000 >5000.000 >5000.000 | | Ac-FQSKKNVFVFGYFELLRAKL-NH2 | 750 |
| JBT0400 | 40 | 216 | C | Ac-FQSKKNVFVFGYFLRLRAKL-NH2 | 267 |
| JBT0401 | | 359 | D | Ac-FQSKKNVFVFGYFERLRAVL-NH2 | 416 |
| JBT0406 | | 210 | C | Ac-Ttds-FQSKKNVFVFGYFERLRAKL-NH2 | 268 |
| JBT0471 | 93 | 29 | A | Ac-FQSKGNVFVTGYFERLRAKL-NH2 | 26 |
| JBT0472 | 96 | 38 | A | Ac-FQSKGNVFVNGYFERLRAKL-NH2 | 27 |
| JBT0473 | 106 | 39 | A | Ac-FQSKGNVFVHGYFERLRAKL-NH2 | 28 |

FIG. 32D

| Object ID | % Inhibition (relative to JBT-0477) | IC50 Mean (nM) | Affinity Class | Sequence | SEQ ID NO: |
|---|---|---|---|---|---|
| JBT0474 | 100 | 27 | A | Ac-FQSKGNVFVKGYFERLRAKL-NH2 | 29 |
| JBT0475 | 106 | 25 | A | Ac-FQSKGNVFVEGYFERLRAKL-NH2 | 30 |
| JBT0476 | 56 | 23 | A | Ac-FQSKGNVFVDGYFDRLRAKL-NH2 | 31 |
| JBT0477 | 99 | 32 | A | Ac-FQSKGNVFVDGYFERLRAKL-NH2 | 32 |
| JBT0478 | | 29 | A | Ac-FQSKDNVFVTGYFERLRAKL-NH2 | 33 |
| JBT0479 | | 48 | A | Ac-FQSKDNVFVNGYFERLRAKL-NH2 | 34 |
| JBT0480 | | 35 | A | Ac-FQSKDNVFVHGYFERLRAKL-NH2 | 35 |
| JBT0481 | | 49 | A | Ac-FQSKDNVFVKGYFERLRAKL-NH2 | 36 |
| JBT0482 | | 38 | A | Ac-FQSKDNVFVEGYFERLRAKL-NH2 | 37 |
| JBT0483 | 74 | 39 | A | Ac-FQSKDNVFVDGYFERLRAKL-NH2 | 38 |
| JBT0485 | | 23 | A | Ac-FQSKNNVFVTGYFERLRAKL-NH2 | 39 |
| JBT0486 | | 40 | A | Ac-FQSKNNVFVNGYFERLRAKL-NH2 | 40 |
| JBT0487 | | 40 | A | Ac-FQSKNNVFVHGYFERIRAKL-NH2 | 41 |
| JBT0488 | | 29 | A | Ac-FQSKNNVFVKGYFERLRAKL-NH2 | 42 |
| JBT0489 | | 30 | A | Ac-FQSKNNVFVEGYFERLRAKL-NH2 | 43 |
| JBT0490 | | 42 | A | Ac-FQSKQNVFVTGYFERLRAKL-NH2 | 44 |
| JBT0491 | | 59 | B | Ac-FQSKQNVFVNGYFERLRAKL-NH2 | 197 |
| JBT0492 | | 68 | B | Ac-FQSKQNVFVHGYFERLRAKL-NH2 | 198 |
| JBT0493 | | 86 | B | Ac-FQSKQNVFVKGYFERIRAKL-NH2 | 199 |
| JBT0494 | | 48 | A | Ac-FQSKQNVFVDGYFERLRAKL-NH2 | 45 |
| JBT0495 | 74 | 52 | B | Ac-FQSKQNVFVEGYFERLRAKL-NH2 | 200 |
| JBT0497 | | 100 | B | Ac-Nmf-QSKGNVFVFGYFERLRAKL-NH2 | 201 |
| JBT0498 | | 1512 | E | Ac-FQ-Nms-KGNVFVFGYFERLRAKL-NH2 | 675 |
| JBT0499 | | 74 | B | Ac-FQS-Nmk-GNVFVFGYFERLRAKL-NH2 | 202 |
| JBT0500 | | 24 | A | Ac-FQSK-Nmg-NVFVFGYFERLRAKL-NH2 | 46 |
| JBT0501 | | 267 | D | Ac-FQSKGN-Nmv-FVFGYFERLRAKL-NH2 | 417 |
| JBT0502 | | >5000 | | Ac-FQSKGNV-Nmf-VFGYFERLRAKL-NH2 | 751 |

FIG. 32E

| Object ID | % Inhibition (relative to JBT-0477) | IC50 Mean (nM) | Affinity Class | Sequence | SEQ ID NO: |
|---|---|---|---|---|---|
| JBT0503 | | 2038 | E | Ac-FQSKGNVF-Nmv-FGYFERLRAKL-NH2 | 676 |
| JBT0504 | | 861 | D | Ac-FQSKGNVFV-Nmf-GYFERLRAKL-NH2 | 418 |
| JBT0505 | | 118 | C | Ac-FQSKGNVFVF-Nmg-YFERLRAKL-NH2 | 269 |
| JBT0506 | | 3106 | F | Ac-FQSKGNVFVFG-Nmy-FERLRAKL-NH2 | 714 |
| JBT0507 | | 2091 | E | Ac-FQSKGNVFVFGY-Nmf-ERLRAKL-NH2 | 677 |
| JBT0508 | | 1192 | E | Ac-FQSKGNVFVFGYF-Nme-RLRAKL-NH2 | 678 |
| JBT0509 | | >5000 | | Ac-FQSKGNVFVFGYFE-Nmr-LRAKL-NH2 | 752 |
| JBT0510 | | >5000 | | Ac-FQSKGNVFVFGYFER-Nml-RAKL-NH2 | 753 |
| JBT0511 | | >5000 | | Ac-FQSKGNVFVFGYFERL-Nmr-AKL-NH2 | 754 |
| JBT0512 | | 2218 | E | Ac-FQSKGNVFVFGYFERLR-Nma-KL-NH2 | 679 |
| JBT0513 | | >5000 | | Ac-FQSKGNVFVFGYFERLRA-Nmk-L-NH2 | 755 |
| JBT0514 | | 891 | D | Ac-FQSKGNVFVFGYFERLRAK-Nml-NH2 | 419 |
| JBT0515 | | 366 | D | Ac-Bhf-QSKGNVFVFGYFERLRAKL-NH2 | 420 |
| JBT0516 | | 1191 | E | Ac-F-Bhq-SKGNVFVFGYFERLRAKL-NH2 | 680 |
| JBT0517 | | 781 | D | Ac-FQ-Bhs-KGNVFVFGYFERLRAKL-NH2 | 421 |
| JBT0518 | | 767 | D | Ac-FQS-Bhk-GNVFVFGYFERLRAKL-NH2 | 422 |
| JBT0519 | | 207 | C | Ac-FQSK-Bal-NVFVFGYFERLRAKL-NH2 | 270 |
| JBT0520 | | 188 | C | Ac-FQSKG-Btq-VFVFGYFERLRAKL-NH2 | 271 |
| JBT0521 | | >5000 | | Ac-FQSKGN-Btl-FVFGYFERLRAKL-NH2 | 756 |
| JBT0522 | | 1424 | E | Ac-FQSKGNV-Bht-VFGYFERLRAKL-NH2 | 681 |
| JBT0523 | | >5000 | | Ac-FQSKGNVF-Btl-FGYFERLRAKL-NH2 | 757 |
| JBT0524 | | 1573 | E | Ac-FQSKGNVFV-Bhf-GYFERLRAKL-NH2 | 682 |
| JBT0525 | | >5000 | | Ac-FQSKGNVFVF-Bal-YFERLRAKL-NH2 | 758 |
| JBT0526 | | >5000 | | Ac-FQSKGNVFVFG-Bhy-FERLRAKL-NH2 | 759 |
| JBT0527 | | 1348 | E | Ac-FQSKGNVFVFGY-Bhf-ERLRAKL-NH2 | 683 |
| JBT0528 | | 107 | C | Ac-FQSKGNVFVFGYF-Bte-RLRAKL-NH2 | 272 |
| JBT0529 | | >5000 | | Ac-FQSKGNVFVFGYFE-Bhr-LRAKL-NH2 | 760 |

FIG. 32F

| Object ID | % Inhibition (relative to JBT-0477) | IC50 Mean (nM) | Affinity Class | Sequence | SEQ ID NO: |
|---|---|---|---|---|---|
| JBT0530 | | 1684 | E | Ac-FQSKGNVFVFGYFER-Bhl-RAKL-NH2 | 684 |
| JBT0531 | | 93 | B | Ac-FQSKGNVFVFGYFERL-Bhr-AKL-NH2 | 203 |
| JBT0532 | | 334 | D | Ac-FQSKGNVFVFGYFERLR-Bal-KL-NH2 | 423 |
| JBT0533 | | 756 | D | Ac-FQSKGNVFVFGYFERLRA-Bhk-L-NH2 | 424 |
| JBT0534 | | 84 | B | Ac-FQSKGNVFVFGYFERLRA-Bhl-NH2 | 204 |
| JBT0535 | | 1779 | E | Ac-FQSKGNVFVFGYFE-Cit-LRAKL-NH2 | 685 |
| JBT0536 | | 229 | C | Ac-FQSKGNVFVFGYFERL-Cit-AKL-NH2 | 273 |
| JBT0537 | | >5000 | | Ac-FQSKGNVFVFGYFE-Nle-LRAKL-NH2 | 761 |
| JBT0538 | | 534 | D | Ac-FQSKGNVFVFGYFERL-Nle-AKL-NH2 | 425 |
| JBT0539 | -1 | 542 | D | Ac-GQSKKNVFVFGYFERLRAKL-NH2 | 426 |
| JBT0540 | 3 | 479 | D | Ac-FGSKKNVFVFGYFERLRAKL-NH2 | 427 |
| JBT0541 | 14 | 292 | D | Ac-FQGKKNVFVFGYFERLRAKL-NH2 | 428 |
| JBT0542 | 14 | 129 | C | Ac-FQSGKNVFVFGYFERLRAKL-NH2 | 274 |
| JBT0543 | 67 | 184 | C | Ac-FQSKGNVFVFGYFERLRAKL-NH2 | 275 |
| JBT0544 | -7 | 746 | D | Ac-FQSKKNNVFVFGYFERLRAKL-NH2 | 429 |
| JBT0545 | -19 | 1780 | E | Ac-FQSKKNVGVFGYFERLRAKL-NH2 | 686 |
| JBT0546 | -15 | >5000 | | Ac-FQSKKNVFGFGYFERLRAKL-NH2 | 762 |
| JBT0547 | -18 | >5000 | | Ac-FQSKKNVFVFGGFERLRAKL-NH2 | 763 |
| JBT0548 | 4 | 885 | D | Ac-FQSKKNVFVFGYGERLRAKL-NH2 | 430 |
| JBT0549 | 35 | 572 | D | Ac-FQSKKNVFVFGYFGRLRAKL-NH2 | 431 |
| JBT0550 | -14 | >5000 | | Ac-FQSKKNVFVFGYFEGLRAKL-NH2 | 764 |
| JBT0551 | -22 | 1640 | E | Ac-FQSKKNVFVFGYFERGRAKL-NH2 | 687 |
| JBT0552 | 10 | 591 | D | Ac-FQSKKNVFVFGYFERLRGKL-NH2 | 432 |
| JBT0553 | -19 | 1101 | E | Ac-FQSKKNVFVFGYFERLRAGL-NH2 | 688 |
| JBT0554 | -5 | 314 | D | Ac-FQSKKNVFVFGYFERLRAKG-NH2 | 433 |
| JBT0555 | 8 | 350 | D | Ac-KQSKKNVFVFGYFERLRAKL-NH2 | 434 |
| JBT0556 | 2 | 336 | D | Ac-FKSKKNVFVFGYFERLRAKL-NH2 | 435 |

FIG. 32G

| Object ID | % Inhibition (relative to JBT-0477) | IC50 Mean [nM] | Affinity Class | Sequence | SEQ ID NO: |
|---|---|---|---|---|---|
| JBT0557 | 27 | 245 | C | Ac-FQKKKNVFVFGYFERLRAKL-NH2 | 276 |
| JBT0558 | 44 | 125 | C | Ac-FQSKKKVFVFGYFERLRAKL-NH2 | 277 |
| JBT0559 | 23 | 203 | C | Ac-FQSKKNKFVFGYFERLRAKL-NH2 | 278 |
| JBT0560 | 2 | 688 | D | Ac-FQSKKNVKVFGYFERLRAKL-NH2 | 436 |
| JBT0561 | 7 | 653 | D | Ac-FQSKKNVFKFGYFERLRAKL-NH2 | 437 |
| JBT0562 | 10 | 413 | D | Ac-FQSKKNVFVFKYFERLRAKL-NH2 | 438 |
| JBT0563 | -6 | 1151 | E | Ac-FQSKKNVFVFGKFERLRAKL-NH2 | 689 |
| JBT0564 | 69 | 95 | B | Ac-FQSKKNVFVFGYFKRLRAKL-NH2 | 205 |
| JBT0565 | -5 | 383 | D | Ac-FQSKKNVFVFGYFEKLRAKL-NH2 | 439 |
| JBT0566 | -7 | 3310 | F | Ac-FQSKKNVFVFGYFERKRAKL-NH2 | 715 |
| JBT0567 | 51 | 225 | C | Ac-FQSKKNVFVFGYFERLKAKL-NH2 | 279 |
| JBT0568 | 49 | 147 | C | Ac-FQSKKNVFVFGYFERLRKKL-NH2 | 280 |
| JBT0569 | 13 |  |  | Ac-FQSKKNVFVFGYFERLRAKK-NH2 | 765 |
| JBT0570 | 4 | >5000 |  | Ac-FFSKKNVFVFGYFERLRAKL-NH2 | 766 |
| JBT0571 | 4 | >5000 |  | Ac-FQFKKNVFVFGYFERLRAKL-NH2 | 767 |
| JBT0572 | 12 | >5000 |  | Ac-FQSFKNVFVFGYFERLRAKL-NH2 | 768 |
| JBT0573 | 5 | 1370 | E | Ac-FQSKFNVFVFGYFERLRAKL-NH2 | 690 |
| JBT0574 | -8 | >5000 |  | Ac-FQSKKFVFVFGYFERLKAKL-NH2 | 769 |
| JBT0575 | 3 | 578 | D | Ac-FQSKKNFFVFGYFERLRAKL-NH2 | 440 |
| JBT0576 | 12 | >1666 |  | Ac-FQSKKNVFFVFGYFERLRAKL-NH2 | 770 |
| JBT0577 | 14 | >5000 |  | Ac-FQSKKNVFVFGFFERLRAKL-NH2 | 771 |
| JBT0578 | 58 | 292 | D | Ac-FQSKKNVFVFGYFFRLRAKL-NH2 | 441 |
| JBT0579 | 4 | >5000 |  | Ac-FQSKKNVFVFGYFEFLRAKL-NH2 | 772 |
| JBT0580 | 12 | >5000 |  | Ac-FQSKKNVFVFGYFERFRAKL-NH2 | 773 |
| JBT0581 | 17 | >5000 |  | Ac-FQSKKNVFVFGYFERLFAKL-NH2 | 774 |
| JBT0582 | 45 | >5000 | E | Ac-FQSKKNVFVFGYFERLRFKL-NH2 | 691 |
| JBT0583 | 13 | >5000 |  | Ac-FQSKKNVFVFGYFERLRAFL-NH2 | 775 |

FIG. 32II

| Object ID | % Inhibition (relative to JBT-0477) | IC50 Mean (nM) | Affinity Class | Sequence | SEQ ID NO: |
|---|---|---|---|---|---|
| JBT0584 | 50 | 401 | D | Ac-FQSKKNVFGYFERLRAKF-NH2 | 442 |
| JBT0585 | 10 | 609 | D | Ac-DQSKKNVFVFGYFERLRAKL-NH2 | 443 |
| JBT0586 | 5 | >1667 | | Ac-FDSKKNVFVFGYFERLRAKL-NH2 | 776 |
| JBT0587 | 50 | 172 | C | Ac-FQDKKNVFVFGYFERLRAKL-NH2 | 281 |
| JBT0588 | 5 | >5000 | | Ac-FQSDKNVFVFGYFERLRAKL-NH2 | 777 |
| JBT0589 | 58 | 241 | C | Ac-FQSKKDVFVFGYFERLRAKL-NH2 | 282 |
| JBT0590 | 2 | >5000 | | Ac-FQSKKNDFVFGYFERLRAKL-NH2 | 778 |
| JBT0591 | 1 | >5000 | | Ac-FQSKKNVDVFGYFERLRAKL-NH2 | 779 |
| JBT0592 | -1 | >5000 | | Ac-FQSKKNVFDFGYFERLRAKL-NH2 | 780 |
| JBT0593 | 6 | 2982 | F | Ac-FQSKKNVFVFDYFERLRAKL-NH2 | 716 |
| JBT0594 | -1 | >5000 | | Ac-FQSKKNVFVFGDFERLRAKL-NH2 | 781 |
| JBT0595 | 10 | 3557 | F | Ac-FQSKKNVFVFGYDERLRAKL-NH2 | 717 |
| JBT0596 | 1 | 549 | D | Ac-FQSKKNVFVFGYFEDLRAKL-NH2 | 444 |
| JBT0597 | -5 | >5000 | | Ac-FQSKKNVFVFGYFERDRAKL-NH2 | 782 |
| JBT0598 | -2 | >5000 | | Ac-FQSKKNVFVFGYFERLDAKL-NH2 | 783 |
| JBT0599 | 30 | 301 | D | Ac-FQSKKNVFVFGYFERLRDKL-NH2 | 445 |
| JBT0600 | -12 | 3232 | F | Ac-FQSLKNVFVFGYFERLRADL-NH2 | 718 |
| JBT0601 | -1 | 1531 | E | Ac-LQSKKNVFVFGYFERLRAKL-NH2 | 692 |
| JBT0602 | 8 | >1000 | | Ac-FLSKKNVFVFGYFERLRAKL-NH2 | 784 |
| | | >1000 | | | |
| | | >5000.000 | | | |
| JBT0603 | 4 | >5000 | | Ac-FQLKKNVFVFGYFERLRAKL-NH2 | 785 |
| JBT0604 | 11 | >1668 | | Ac-FQSLKNVFVFGYFERLRAKL-NH2 | 786 |
| JBT0605 | 18 | >1669 | | Ac-FQSKLNVFVFGYFERLRAKL-NH2 | 787 |
| JBT0606 | 1 | >5000 | | Ac-FQSKKLVFVFGYFERLRAKL-NH2 | 788 |
| JBT0607 | 19 | 718 | D | Ac-FQSKKNLFVFGYFERLRAKL-NH2 | 446 |
| JBT0608 | 4 | 2673 | F | Ac-FQSKKNVLVFGYFERLRAKL-NH2 | 719 |

FIG. 32I

| Object ID | % Inhibition (relative to JBT-0477) | IC50 Mean (nM) | Affinity Class | Sequence | SEQ ID NO: |
|---|---|---|---|---|---|
| JBT0609 | 0 | >5000 | | Ac-FQSKKNVFLFGYFERLRAKL-NH2 | 789 |
| JBT0610 | -4 | >5000 | | Ac-FQSKKNVFFLYFERLRAKL-NH2 | 790 |
| JBT0611 | -5 | >5000 | | Ac-FQSKKNVFVFGLFERLRAKL-NH2 | 791 |
| JBT0612 | 9 | 1378 | E | Ac-FQSKKNVFVFGYLERLRAKL-NH2 | 693 |
| JBT0613 | | 237 | C | Ac-FQSKGNVFVFGYFERLRAKL-OH | 283 |
| JBT0614 | | 2575 | F | H-FQSKGNVFVFGYFERLRAKL-OH | 720 |
| JBT0615 | | 249 | C | H-FQSKGNVFVFGYFERLRAKL-OH | 284 |
| JBT0616 | | 124 | C | H-GSFQSKKNVFVDGYFERLRAKL-OH | 285 |
| JBT0636 | | 24 | A | Ac-FQSK-Nmg-NVFVDGYFARLRAKL-NH2 | 47 |
| JBT0651 | | 18 | A | Ac-FQSKGNVHVKGYFERLRAKL-NH2 | 48 |
| JBT0652 | 103 | 36 | A | Ac-FQSKGNVHVDGYFERLRAKL-NH2 | 49 |
| JBT0653 | | 23 | A | Ac-FQSPGNVHVKGYFERLRAKL-NH2 | 50 |
| JBT0654 | | 16 | A | Ac-FQSPGNVHVDGYFERLRAKL-NH2 | 51 |
| JBT0655 | | 38 | A | Ac-FQSKGNIFVFGYFERLRAKL-NH2 | 52 |
| JBT0656 | | 155 | C | Ac-FQSKGNLVFGYFERLRAKL-NH2 | 286 |
| JBT0657 | | 142 | C | Ac-FQSKGNVFIFGYFERLRAKL-NH2 | 287 |
| JBT0658 | | 1062 | E | Ac-FQSKGNVFLFGYFERLRAKL-NH2 | 694 |
| JBT0663 | | 45 | A | Ac-FQSKaNVFVFGYFERLRAKL-NH2 | 53 |
| JBT0668 | | 49 | A | Ac-FQSKaNVFVTGYFARLRAKL-NH2 | 54 |
| JBT0681 | | 68 | B | Ac-FQSK-Nmg-AVFVFGYFARLRAKL-NH2 | 206 |
| JBT0683 | | 25 | A | Ac-FQSK-Nmg-AVFVDGYFARLRAKL-NH2 | 55 |
| JBT0691 | 32 | | F | Ac-AQSKKNVFVFGYFERLRAKL-NH2 | 721 |
| JBT0692 | 49 | | E | Ac-FASKKNVFVFGYFERLRAKL-NH2 | 695 |
| JBT0693 | 60 | | D | Ac-FQAKKNVFVFGYFERLRAKL-NH2 | 447 |
| JBT0694 | 58 | | D | Ac-FQSAKNVFVFGYFERLRAKL-NH2 | 448 |
| JBT0695 | 52 | | D | Ac-FQSKANVFVFGYFERLRAKL-NH2 | 449 |
| JBT0696 | 94 | 101 | C | Ac-FQSKKAVFVFGYFERLRAKL-NH2 | 288 |

FIG. 32J

| Object ID | % Inhibition (relative to JBT-0477) | IC50 Mean (nM) | Affinity Class | Sequence | SEQ ID NO: |
|---|---|---|---|---|---|
| JBT0697 | | 47 | A | Ac-FQSKGNVFVDGYFERL-Dap-AKL-NH2 | 56 |
| JBT0698 | -1 | | | Ac-FQSKKNVAVFGYFERLRAKL-NH2 | 792 |
| JBT0699 | | 37 | A | Ac-FQSKGNVFVDGYFERL-Orn-AKL-NH2 | 57 |
| JBT0700 | | 26 | A | Ac-FQSKGNVFVDGYFERL-Nva-AKL-NH2 | 58 |
| JBT0701 | 29 | | | Ac-FQSKKNVFFAYFERLRAKL-NH2 | 793 |
| JBT0702 | 10 | | | Ac-FQSKKNVFVFGAFERLRAKL-NH2 | 794 |
| JBT0703 | 22 | | | Ac-FQSKKNVFVFGYAERLRAKL-NH2 | 795 |
| JBT0704 | 96 | 116 | C | Ac-FQSKKNVFVFGYFARLRAKL-NH2 | 289 |
| JBT0705 | 22 | | | Ac-FQSKKNVFVFGYFEALRAKL-NH2 | 796 |
| JBT0706 | 10 | | | Ac-FQSKKNVFVFGYFERARAKL-NH2 | 797 |
| JBT0707 | 50 | 502 | D | Ac-FQSKKNVFVFGYFERLAAKL-NH2 | 450 |
| JBT0708 | | 30 | A | Ac-FQSKaNVFVAGYFERLRAKL-NH2 | 59 |
| JBT0709 | 6 | | | Ac-FQSKKNVFVFGYFERLAAL-NH2 | 798 |
| JBT0710 | -2 | | | Ac-FQSKKNVFVFGYFERLRAKA-NH2 | 799 |
| JBT0711 | 2 | | | Ac-PQSKKNVFVFGYFERLRAKL-NH2 | 800 |
| JBT0712 | 19 | | | Ac-FPSKKNVFVFGYFERLRAKL-NH2 | 801 |
| JBT0713 | 5 | 679 | D | Ac-FQPKKNVFVFGYFERLRAKL-NH2 | 451 |
| JBT0714 | | 23 | A | Ac-FQSkaAVFVDGYFARLRAKL-NH2 | 60 |
| JBT0715 | 40 | | F | Ac-FQSKPNVFVFGYFERLRAKL-NH2 | 722 |
| JBT0716 | 42 | | E | Ac-FQSKKPVFVFGYFERLRAKL-NH2 | 696 |
| JBT0717 | | 24 | A | Ac-FQSK-Nmg-NVFVDGYFERLRAKL-NH2 | 61 |
| JBT0718 | 14 | | | Ac-FQSKKNVPVFGYFERLRAKL-NH2 | 802 |
| JBT0719 | 31 | | F | Ac-FQSKKNVFVPPFGYFERLRAKL-NH2 | 723 |
| JBT0720 | | 27 | A | Ac-FQSK-Nmg-NVFVTGYFARLRAKL-NH2 | 62 |
| JBT0721 | 29 | | | Ac-FQSKKNVFVFPYFERLRAKL-NH2 | 803 |
| JBT0722 | 12 | | | Ac-FQSKKNVFVFGPFERLRAKL-NH2 | 804 |
| JBT0723 | 3 | | | Ac-FQSKKNVFVFGYPERLRAKL-NH2 | 805 |

FIG. 32K

| Object ID | % Inhibition (relative to JBT-0477) | IC50 Mean (nM) | Affinity Class | Sequence | SEQ ID NO: |
|---|---|---|---|---|---|
| JBT0724 | 50 | | D | Ac-FQSKKNVFVFGYFPRLRAKL-NH2 | 452 |
| JBT0725 | 21 | | | Ac-FQSKKNVFVFGYFEPLRAKL-NH2 | 806 |
| JBT0726 | 2 | | D | Ac-FQSKKNVFVFGYFERPRAKL-NH2 | 453 |
| JBT0727 | -1 | | | Ac-FQSKKNVFVFGYFERLPAKL-NH2 | 807 |
| JBT0728 | 12 | | | Ac-FQSKKNVFVFGYFERLRPKL-NH2 | 808 |
| JBT0729 | 4 | | | Ac-FQSKKNVFVFGYFERLRAPL-NH2 | 809 |
| JBT0730 | 3 | | D | Ac-FQSKKNVFVFGYFERLRAKP-NH2 | 454 |
| JBT0731 | 21 | | | Ac-SQSKKNVFVFGYFERLRAKL-NH2 | 810 |
| JBT0732 | | 20 | A | Ac-FQSKGNVFVDGYFERL-Hci-AKL-NH2 | 63 |
| JBT0733 | | 26 | A | Ac-FQSKGNVFVDGYFERL-Har-AKL-NH2 | 64 |
| JBT0734 | 26 | | D | Ac-FQSKNVFVFGYFERLRAKL-NH2 | 455 |
| JBT0735 | 19 | | | Ac-FQSKSNVFVFGYFERLRAKL-NH2 | 811 |
| JBT0736 | 68 | | D | Ac-FQSKKSVFVFGYFERLRAKL-NH2 | 456 |
| JBT0737 | 34 | | F | Ac-FQSKKNSFVFGYFERLRAKL-NH2 | 724 |
| JBT0738 | 20 | | | Ac-FQSKKNVSVFGYFERLRAKL-NH2 | 812 |
| JBT0739 | | 31 | A | Ac-FQSKGNVFVDGYFERL-Opa-AKL-NH2 | 65 |
| JBT0740 | 113 | 18 | A | Ac-FQSKGNVFVDGYFERL-Aib-AKL-NH2 | 66 |
| JBT0741 | 44 | | E | Ac-FQSKKNVFVFSYFERLRAKL-NH2 | 697 |
| JBT0742 | 12 | | | Ac-FQSKKNVFVFGSFERLRAKL-NH2 | 813 |
| JBT0743 | 5 | | | Ac-FQSKKNVFVFGYSERLRAKL-NH2 | 814 |
| JBT0744 | 66 | | D | Ac-FQSKKNVFVFGYFSRLRAKL-NH2 | 457 |
| JBT0745 | 9 | | | Ac-FQSKKNVFVFGYFESLRAKL-NH2 | 815 |
| JBT0746 | -1 | | | Ac-FQSKKNVFVFGYFERSRAKL-NH2 | 816 |
| JBT0747 | 19 | | | Ac-FQSKKNVFVFGYFERLSAKL-NH2 | 817 |
| JBT0748 | 43 | | D | Ac-FQSKKNVFVFGYFERLRSKL-NH2 | 458 |
| JBT0749 | 19 | | D | Ac-FQSKKNVFVFGYFERLRASL-NH2 | 459 |
| JBT0750 | 10 | | | Ac-FQSKKNVFVFGYFERLRAKS-NH2 | 818 |

FIG. 32L

| Object ID | % Inhibition (relative to JBT-0477) | IC50 Mean (nM) | Affinity Class | Sequence | SEQ ID NO: |
|---|---|---|---|---|---|
| JBT0751 | 33 | | F | Ac-FQSKKNVFVFGYFERLLAKL-NH2 | 725 |
| JBT0752 | 46 | | E | Ac-FQSKKNVFVFGYFERLRLKL-NH2 | 698 |
| JBT0753 | 26 | | D | Ac-FQSKKNVFVFGYFERLRALL-NH2 | 460 |
| JBT0754 | | 33 | A | Ac-FQSK-Nmg-AVFVTGYFARLRAKL-NH2 | 67 |
| JBT0755 | 34 | >5000 | F | Ac-fQSKKNVFVFGYFERLRAKL-NH2 | 726 |
| JBT0756 | 35 | >5000 | F | Ac-FqSKKNVFVFGYFERLRAKL-NH2 | 727 |
| JBT0757 | | 2212 | E | Ac-FQsKKNVFVFGYFERLRAKL-NH2 | 699 |
| JBT0758 | 52 | 101 | C | Ac-FQSkKNVFVFGYFERLRAKL-NH2 | 290 |
| JBT0759 | 78 | 52 | B | Ac-FQSKkNVFVFGYFERLRAKL-NH2 | 207 |
| JBT0760 | 37 | | F | Ac-FQSKKnVFVFGYFERLRAKL-NH2 | 728 |
| JBT0761 | 35 | | F | Ac-FQSKKNvFVFGYFERLRAKL-NH2 | 729 |
| JBT0762 | 37 | | F | Ac-FQSKKNVfVFGYFERLRAKL-NH2 | 730 |
| JBT0763 | 58 | 129 | C | Ac-FQSKKNVFfFGYFERLRAKL-NH2 | 291 |
| JBT0764 | 53 | 296 | D | Ac-FQSKKNVFVfGYFERLRAKL-NH2 | 461 |
| JBT0765 | | 26 | A | Ac-FQSKKNVFVDGYFERL-Eew-AKL-NH2 | 68 |
| JBT0766 | 32 | | D | Ac-FQSKKNVFVFGyFERLRAKL-NH2 | 462 |
| JBT0767 | 40 | | E | Ac-FQSKKNVFVFGYfERLRAKL-NH2 | 700 |
| JBT0768 | 27 | | D | Ac-FQSKKNVFVFGYFeRLRAKL-NH2 | 463 |
| JBT0769 | 22 | | D | Ac-FQSKKNVFVFGYFErLRAKL-NH2 | 464 |
| JBT0770 | 20 | | | Ac-FQSKKNVFVFGYFERlRAKL-NH2 | 819 |
| JBT0771 | 29 | 423 | D | Ac-FQSKKNVFVFGYFERLrAKL-NH2 | 465 |
| JBT0772 | 21 | | | Ac-FQSKKNVFVFGYFERLRaKL-NH2 | 820 |
| JBT0773 | 21 | | | Ac-FQSKKNVFVFGYFERLRAkL-NH2 | 821 |
| JBT0774 | 26 | | | Ac-FQSKKNVFVFGYFERLRAKl-NH2 | 822 |
| JBT0775 | 73 | 22 | A | Ac-FQSKGNVFVTGYFDRLRAKL-NH2 | 69 |
| JBT0776 | 51 | 82 | B | Ac-FQSKGNVFVNGYFDRLRAKL-NH2 | 208 |
| JBT0777 | 49 | 101 | C | Ac-FQSKGNVFVHGYFDRLRAKL-NH2 | 292 |

FIG. 32M

| Object ID | % Inhibition (relative to JBT-0477) | IC50 Mean (nM) | Affinity Class | Sequence | SEQ ID NO: |
|---|---|---|---|---|---|
| JBT0778 | 68 | 66 | B | Ac-FQSKGNVFVKGYHDRLRAKL-NH2 | 209 |
| JBT0779 | 51 | 71 | B | Ac-FQSKGNVFVEGYFDRLRAKL-NH2 | 210 |
| JBT0780 |  | 44 | A | Ac-FQSK-Nmg-NVFVFGYFARLRAKL-NH2 | 70 |
| JBT0781 | 82 | 63 | B | Ac-FQSKGNVFVDGYFKRLRAKL-NH2 | 211 |
| JBT0782 | 44 | >556 | D | Ac-fqsknvfgyferlrakl-NH2 | 466 |
| JBT0783 | 39 | >556 >555.556 | D | Ac-lkarlrefygfvfvnkksqf-NH2 | 467 |
| JBT0784 |  | >1666.670 >5000 |  | Ac-FQSKKNVFVFGYFE-(omega-methyl-R)-L-(omega-methyl-R)-AKL-NH2 | 823 |
| JBT0785 |  | 163 | C | Ac-FQSKKNVFVFGYFERL-(omega-methyl-R)-AKL-NH2 | 293 |
| JBT0786 |  | 616 | D | Ac-FQSKKNVFVFGYFE-(omega-methyl-R)-LRAKL-NH2 | 468 |
| JBT0789 |  | 20 | A | Ac-FQSK-Nmg-NVFVDGYFERL-Nle-AKL-NH2 | 71 |
| JBT0791 | 42 |  | D | Ac-AQSKGNVFVDGYFERLRAKL-NH2 | 469 |
| JBT0792 | 5 |  | D | Ac-FASKGNVFVDGYFERLRAKL-NH2 | 470 |
| JBT0793 | 88 |  | C | Ac-FQAKGNVFVDGYFERLRAKL-NH2 | 294 |
| JBT0794 | 90 | 156 | C | Ac-FQSAGNVFVDGYFERLRAKL-NH2 | 295 |
| JBT0795 | 92 | 34 | A | Ac-FQSKGAVFVDGYFERLRAKL-NH2 | 72 |
| JBT0796 | 70 |  | D | Ac-FQSKGNAFVDGYFERLRAKL-NH2 | 471 |
| JBT0797 | -2 |  |  | Ac-FQSKGNVAVDGYFERLRAKL-NH2 | 824 |
| JBT0798 | 39 |  | F | Ac-FQSKGNVFADGYFERLRAKL-NH2 | 731 |
| JBT0799 | 8 |  |  | Ac-FQSKGNVFVDAYFERLRAKL-NH2 | 825 |
| JBT0800 | -2 |  |  | Ac-FQSKGNVFVDGAFERLRAKL-NH2 | 826 |
| JBT0801 | 64 |  | D | Ac-FQSKGNVFVDGYAERLRAKL-NH2 | 472 |
| JBT0802 | 101 | 35 | A | Ac-FQSKGNVFVDGYFARLRAKL-NH2 | 73 |
| JBT0803 | 7 |  | D | Ac-FQSKGNVFVDGYFEALRAKL-NH2 | 473 |
| JBT0804 | 10 |  |  | Ac-FQSKGNVFVDGYFERARAKL-NH2 | 827 |
| JBT0805 | 98 | 64 | B | Ac-FQSKGNVFVDGYFERLAAKL-NH2 | 212 |

FIG. 32N

| Object ID | % Inhibition (relative to JBT-0477) | IC50 Mean (nM) | Affinity Class | Sequence | SEQ ID NO: |
|---|---|---|---|---|---|
| JBT0806 | | 42 | A | Ac-FQSK-Nmg-NVFVAGYFARLRAKL-NH2 | 74 |
| JBT0807 | -6 | | | Ac-FQSKGNVFVDGYFERLRAAL-NH2 | 828 |
| JBT0808 | 39 | | F | Ac-FQSKGNVFVDGYFERLRAKA-NH2 | 732 |
| JBT0809 | 10 | | | Ac-DQSKGNVFVDGYFERLRAKL-NH2 | 829 |
| JBT0810 | -1 | | | Ac-FDSKGNVFVDGYFERLRAKL-NH2 | 830 |
| JBT0811 | 69 | | D | Ac-FQDKGNVFVDGYFERLRAKL-NH2 | 474 |
| JBT0812 | 81 | | C | Ac-FQSDGNVFVDGYFERLRAKL-NH2 | 296 |
| JBT0813 | 76 | | D | Ac-FQSKGDVFVDGYFERLRAKL-NH2 | 475 |
| JBT0814 | 4 | | | Ac-FQSKGNDFVDGYFERLRAKL-NH2 | 831 |
| JBT0815 | 2 | | | Ac-FQSKGNVDVDGYFERLRAKL-NH2 | 832 |
| JBT0816 | 1 | | | Ac-FQSKGNVFDDGYFERLRAKL-NH2 | 833 |
| JBT0817 | 5 | | | Ac-FQSKGNVFVDDYFERLRAKL-NH2 | 834 |
| JBT0818 | 3 | | D | Ac-FQSKGNVFVDGDFERLRAKL-NH2 | 476 |
| JBT0819 | 31 | | D | Ac-FQSKGNVFVDGYDERLRAKL-NH2 | 477 |
| JBT0820 | 0 | | | Ac-FQSKGNVFVDGYFEDLRAKL-NH2 | 835 |
| JBT0821 | -3 | | | Ac-FQSKGNVFVDGYFERDRAKL-NH2 | 836 |
| JBT0822 | 51 | | D | Ac-FQSKGNVFVDGYFERLDAKL-NH2 | 478 |
| JBT0823 | 82 | | C | Ac-FQSKGNVFVDGYFERLRDKL-NH2 | 297 |
| JBT0824 | 3 | | | Ac-FQSKGNVFVDGYFERLRADL-NH2 | 837 |
| JBT0825 | 9 | | | Ac-FQSKGNVFVDGYFERLRAKD-NH2 | 838 |
| JBT0826 | 22 | | D | Ac-EQSKGNVFVDGYFERLRAKL-NH2 | 479 |
| JBT0827 | -3 | | | Ac-FESKGNVFVDGYFERLRAKL-NH2 | 839 |
| JBT0828 | 90 | | C | Ac-FQEKGNVFVDGYFERLRAKL-NH2 | 298 |
| JBT0829 | 104 | | A | Ac-FQSEGNVFVDGYFERLRAKL-NH2 | 75 |
| JBT0830 | 75 | | D | Ac-FQSKGEVFVDGYFERLRAKL-NH2 | 480 |
| JBT0831 | 18 | | D | Ac-FQSKGNFFVDGYFERLRAKL-NH2 | 481 |
| JBT0832 | -5 | | | Ac-FQSKGNVEVDGYFERLRAKL-NH2 | 840 |

FIG. 32O

| Object ID | % Inhibition (relative to JBT-0477) | IC50 Mean (nM) | Affinity Class | Sequence | SEQ ID NO: |
|---|---|---|---|---|---|
| JBT0833 | 11 | | | Ac-FQSKGNVFEDGYFERLRAKL-NH2 | 841 |
| JBT0834 | 13 | | | Ac-FQSKGNVFVDEYFERLRAKL-NH2 | 842 |
| JBT0835 | 5 | | | Ac-FQSKGNVFVDGEFERLRAKL-NH2 | 843 |
| JBT0836 | 51 | | D | Ac-FQSKGNVFVDGYEERLRAKL-NH2 | 482 |
| JBT0837 | | 87 | B | Ac-FQSK-Nmg-NVFVTGYFERL-Nle-AKL-NH2 | 213 |
| JBT0838 | 4 | | D | Ac-FQSKGNVFVDGYFEELRAKL-NH2 | 483 |
| JBT0839 | 4 | | | Ac-FQSKGNVFVDGYFERERAKL-NH2 | 844 |
| JBT0840 | 71 | | D | Ac-FQSKGNVFVDGYFERLEAKL-NH2 | 484 |
| JBT0841 | 82 | | | Ac-FQSKGNVFVDGYFERLREKL-NH2 | 299 |
| JBT0842 | 3 | | | Ac-FQSKGNVFVDGYFERLRAEL-NH2 | 845 |
| JBT0843 | 21 | | | Ac-FQSKGNVFVDGYFERLRAKE-NH2 | 846 |
| JBT0844 | | 112 | C | Ac-FQSKaNVFVDGYFERLRAKL-NH2 | 300 |
| JBT0845 | 5 | | D | Ac-FFSKGNVFVDGYFERLRAKL-NH2 | 485 |
| JBT0846 | 66 | | D | Ac-FQFKGNVFVDGYFERLRAKL-NH2 | 486 |
| JBT0847 | 82 | | C | Ac-FQSFGNVFVDGYFERLRAKL-NH2 | 301 |
| JBT0848 | 69 | | D | Ac-FQSKGFVFVDGYFERLRAKL-NH2 | 487 |
| JBT0849 | 48 | | D | Ac-FQSKGNFFVDGYFERLRAKL-NH2 | 488 |
| JBT0850 | | 150 | C | Ac-FQSKaAVFVAGYFARLRAKL-NH2 | 302 |
| JBT0851 | 6 | | D | Ac-FQSKGNVFFDGYFERLRAKL-NH2 | 489 |
| JBT0852 | 18 | | | Ac-FQSKGNVFVDFYFERLRAKL-NH2 | 847 |
| JBT0853 | 13 | | | Ac-FQSKGNVFVDGFFERLRAKL-NH2 | 848 |
| JBT0854 | | 593 | D | Ac-FQSKaAVFVAGYFARL-Nle-AKL-NH2 | 490 |
| JBT0855 | 57 | | D | Ac-FQSKGNVFVDGYFFRLRAKL-NH2 | 491 |
| JBT0856 | 4 | | D | Ac-FQSKGNVFVDGYFEFLRAKL-NH2 | 492 |
| JBT0857 | 13 | | | Ac-FQSKGNVFVDGYFERFRAKL-NH2 | 849 |
| JBT0858 | 85 | | C | Ac-FQSKGNVFVDGYFERLFAKL-NH2 | 303 |
| JBT0859 | 81 | | C | Ac-FQSKGNVFVDGYFERLRFKL-NH2 | 304 |

FIG. 32P

| Object ID | % Inhibition (relative to JBT-0477) | IC50 Mean (nM) | Affinity Class | Sequence | SEQ ID NO: |
|---|---|---|---|---|---|
| JBT0860 | 1 | | | Ac-FQSKGNVFVDGYFERLRAFL-NH2 | 850 |
| JBT0861 | 94 | | C | Ac-FQSKGNVFVDGYFERLRAKF-NH2 | 305 |
| JBT0862 | 23 | | | Ac-GQSKGNVFVDGYFERLRAKL-NH2 | 851 |
| JBT0863 | 7 | | D | Ac-FGSKGNVFVDGYFERLRAKL-NH2 | 493 |
| JBT0864 | 60 | | D | Ac-FQGKGNVFVDGYFERLRAKL-NH2 | 494 |
| JBT0865 | 69 | | D | Ac-FQSGGNVFVDGYFERLRAKL-NH2 | 495 |
| JBT0866 | 79 | | D | Ac-FQSKGGVFVDGYFERLRAKL-NH2 | 496 |
| JBT0867 | 2 | | | Ac-FQSKGNGFVDGYFERLRAKL-NH2 | 852 |
| JBT0868 | 4 | | | Ac-FQSKGNVGVDGYFERLRAKL-NH2 | 853 |
| JBT0869 | -1 | | | Ac-FQSKGNVFGDGYFERLRAKL-NH2 | 854 |
| JBT0870 | | 57 | B | Ac-FQSKaAVFVTGYFARLRAKL-NH2 | 214 |
| JBT0871 | 1 | | | Ac-FQSKGNVFVDGGFERLRAKL-NH2 | 855 |
| JBT0872 | 24 | | D | Ac-FQSKGNVFVDGYGERLRAKL-NH2 | 497 |
| JBT0873 | 64 | | D | Ac-FQSKGNVFVDGYFGRLRAKL-NH2 | 498 |
| JBT0874 | 1 | | D | Ac-FQSKGNVFVDGYFEGLRAKL-NH2 | 499 |
| JBT0875 | -5 | | | Ac-FQSKGNVFVDGYFERGRAKL-NH2 | 856 |
| JBT0876 | 75 | | D | Ac-FQSKGNVFVDGYFERLGAKL-NH2 | 500 |
| JBT0877 | 50 | | E | Ac-FQSKGNVFVDGYFERLRGKL-NH2 | 701 |
| JBT0878 | 9 | | | Ac-FQSKGNVFVDGYFERLRAGL-NH2 | 857 |
| JBT0879 | 29 | | | Ac-FQSKGNVFVDGYFERLRAKG-NH2 | 858 |
| JBT0880 | 56 | | D | Ac-HQSKGNVFVDGYFERLRAKL-NH2 | 501 |
| JBT0881 | -2 | | | Ac-FHSKGNVFVDGYFERLRAKL-NH2 | 859 |
| JBT0882 | 85 | | C | Ac-FQHKGNVFVDGYFERLRAKL-NH2 | 306 |
| JBT0883 | 93 | | C | Ac-FQSHGNVFVDGYFERLRAKL-NH2 | 307 |
| JBT0884 | 71 | | D | Ac-FQSKGHVFVDGYFERLRAKL-NH2 | 502 |
| JBT0885 | 50 | | D | Ac-FQSKGNHFVDGYFERLRAKL-NH2 | 503 |
| JBT0886 | | 50 | B | Ac-FQSKaNVFVDGYFARLRAKL-NH2 | 215 |

FIG. 32Q

| Object ID | % Inhibition (relative to JBT-0477) | IC50 Mean (nM) | Affinity Class | Sequence | SEQ ID NO: |
|---|---|---|---|---|---|
| JBT0887 | 0 | | | Ac-FQSKGNVFHDGYFERLRAKL-NH2 | 860 |
| JBT0888 | 35 | | D | Ac-FQSKGNVFVDHYFERLRAKL-NH2 | 504 |
| JBT0889 | -8 | | | Ac-FQSKGNVFVDGHFERLRAKL-NH2 | 861 |
| JBT0890 | 71 | | D | Ac-FQSKGNVFVDGYHERLRAKL-NH2 | 505 |
| JBT0891 | 93 | | C | Ac-FQSKGNVFVDGYFHRLRAKL-NH2 | 308 |
| JBT0892 | -8 | | | Ac-FQSKGNVFVDGYFEHLRAKL-NH2 | 862 |
| JBT0893 | -10 | | | Ac-FQSKGNVFVDGYFERHRAKL-NH2 | 863 |
| JBT0894 | 103 | 42 | A | Ac-FQSKGNVFVDGYFERLHAKL-NH2 | 76 |
| JBT0895 | 69 | | D | Ac-FQSKGNVFVDGYFERLRHKL-NH2 | 506 |
| JBT0896 | -12 | | | Ac-FQSKGNVFVDGYFERLRAHL-NH2 | 864 |
| JBT0897 | 71 | | D | Ac-FQSKGNVFVDGYFERLRAKH-NH2 | 507 |
| JBT0898 | 87 | | C | Ac-IQSKGNVFVDGYFERLRAKL-NH2 | 309 |
| JBT0899 | 7 | | D | Ac-FISKGNVFVDGYFERLRAKL-NH2 | 508 |
| JBT0900 | 88 | | C | Ac-FQIKGNVFVDGYFERLRAKL-NH2 | 310 |
| JBT0901 | 96 | | A | Ac-FQSIGNVFVDGYFERLRAKL-NH2 | 77 |
| JBT0902 | 94 | | C | Ac-FQSKGIVFVDGYFERLRAKL-NH2 | 311 |
| JBT0903 | 97 | | A | Ac-FQSKGNIFVDGYFERLRAKL-NH2 | 78 |
| JBT0904 | 2 | | | Ac-FQSKGNVIVDGYFERLRAKL-NH2 | 865 |
| JBT0905 | 58 | | D | Ac-FQSKGNVFIDGYFERLRAKL-NH2 | 509 |
| JBT0906 | -2 | | | Ac-FQSKGNVFVDIYFERLRAKL-NH2 | 866 |
| JBT0907 | 1 | | | Ac-FQSKGNVFVDGIFERLRAKL-NH2 | 867 |
| JBT0908 | 39 | | D | Ac-FQSKGNVFVDGYIERLRAKL-NH2 | 510 |
| JBT0909 | 92 | | C | Ac-FQSKGNVFVDGYFIRLRAKL-NH2 | 312 |
| JBT0910 | 0 | | | Ac-FQSKGNVFVDGYFEILRAKL-NH2 | 868 |
| JBT0911 | 15 | | | Ac-FQSKGNVFVDGYFERIRAKL-NH2 | 869 |
| JBT0912 | 104 | 57 | B | Ac-FQSKGNVFVDGYFERLIAKL-NH2 | 216 |
| JBT0913 | 65 | | D | Ac-FQSKGNVFVDGYFERLRIKL-NH2 | 511 |

FIG. 32R

| Object ID | % Inhibition (relative to JBT-0477) | IC50 Mean (nM) | Affinity Class | Sequence | SEQ ID NO: |
|---|---|---|---|---|---|
| JBT0914 | -7 | | | Ac-FQSKGNVFVDGYFERLRAIL-NH2 | 870 |
| JBT0915 | 80 | | D | Ac-FQSKGNVFVDGYFERLRAKI-NH2 | 512 |
| JBT0916 | 59 | | D | Ac-KQSKGNVFVDGYFERLRAKL-NH2 | 513 |
| JBT0917 | -3 | | | Ac-FKSKGNVFVDGYFERLRAKL-NH2 | 871 |
| JBT0918 | 65 | | D | Ac-FQKKGNVFVDGYFERLRAKL-NH2 | 514 |
| JBT0919 | | 42 | A | Ac-FQSKaNVFVTGYFERLRAKL-NH2 | 79 |
| JBT0920 | 115 | 23 | A | Ac-FQSGKVFVDGYFERLRAKL-NH2 | 80 |
| JBT0921 | 11 | | | Ac-FQSKGNKFVDGYFERLRAKL-NH2 | 872 |
| JBT0922 | -4 | | | Ac-FQSKGNVFKVDGYFERLRAKL-NH2 | 873 |
| JBT0923 | 3 | | D | Ac-FQSKGNVFKDGYFERLRAKL-NH2 | 515 |
| JBT0924 | 17 | | | Ac-FQSKGNVFVDKYFERLRAKL-NH2 | 874 |
| JBT0925 | -6 | | | Ac-FQSKGNVFVDGKFERLRAKL-NH2 | 875 |
| JBT0926 | 20 | | D | Ac-FQSKGNVFVDGYKERLRAKL-NH2 | 516 |
| JBT0927 | -8 | | | Ac-FQSKGNVFVDGYFEKLRAKL-NH2 | 876 |
| JBT0928 | 4 | | | Ac-FQSKGNVFVDGYFERKRAKL-NH2 | 877 |
| JBT0929 | 107 | 29 | A | Ac-FQSKGNVFVDGYFERLRAKL-NH2 | 81 |
| JBT0930 | 44 | | E | Ac-FQSKGNVFVDGYFERLRKKL-NH2 | 702 |
| JBT0931 | | 33 | A | Ac-FQSKGNVFVDGYFERL-Eag-AKL-NH2 | 82 |
| JBT0932 | 47 | | E | Ac-FQSKGNVFVDGYFERLRAKK-NH2 | 703 |
| JBT0933 | 75 | | D | Ac-LQSKGNVFVDGYFERLRAKL-NH2 | 517 |
| JBT0934 | -7 | | | Ac-FLSKGNVFVDGYFERLRAKL-NH2 | 878 |
| JBT0935 | 72 | | D | Ac-FQLKGNVFVDGYFERLRAKL-NH2 | 518 |
| JBT0936 | 97 | 41 | A | Ac-FQSLGNVFVDGYFERLRAKL-NH2 | 83 |
| JBT0937 | 90 | | C | Ac-FQSKGLVFVDGYFERLRAKL-NH2 | 313 |
| JBT0938 | 44 | | D | Ac-FQSKGNLFVDGYFERLRAKL-NH2 | 519 |
| JBT0939 | 27 | | | Ac-FQSKGNVLVDGYFERLRAKL-NH2 | 879 |
| JBT0940 | 4 | | | Ac-FQSKGNVFLDGYFERLRAKL-NH2 | 880 |

FIG. 32S

| Object ID | % Inhibition (relative to JBT-0477) | IC50 Mean (nM) | Affinity Class | Sequence | SEQ ID NO: |
|---|---|---|---|---|---|
| JBT0941 | 28 | | D | Ac-FQSKGNVFVDLYFERLRAKL-NH2 | 520 |
| JBT0942 | 4 | | D | Ac-FQSKGNVFVDGLFERLRAKL-NH2 | 521 |
| JBT0943 | 83 | | C | Ac-FQSKGNVFVDGYLERLRAKL-NH2 | 314 |
| JBT0944 | 103 | | A | Ac-FQSKGNVFVDGYFLRLRAKL-NH2 | 84 |
| JBT0945 | 1 | | D | Ac-FQSKGNVFVDGYFELLRAKL-NH2 | 522 |
| JBT0946 | | 38 | A | Ac-FQSKGNVFVDGYFERL-Dab-AKL-NH2 | 85 |
| JBT0947 | 105 | | A | Ac-FQSKGNVFVDGYFERLLAKL-NH2 | 86 |
| JBT0948 | 108 | 46 | A | Ac-FQSKGNVFVDGYFERLRLKL-NH2 | 87 |
| JBT0949 | 2 | | | Ac-FQSKGNVFVDGYFERLRALL-NH2 | 881 |
| JBT0950 | | 73 | B | Ac-FQSKaNVFVfGYFARLRAKL-NH2 | 217 |
| JBT0951 | 97 | | A | Ac-MQSKGNVFVDGYFERLRAKL-NH2 | 88 |
| JBT0953 | 109 | 43 | A | Ac-FQMKGNVFVDGYFERLRAKL-NH2 | 89 |
| JBT0956 | 27 | | | Ac-FQSKGNMFVDGYFERLRAKL-NH2 | 882 |
| JBT0961 | 77 | | D | Ac-FQSKGNVFVDGYMERLRAKL-NH2 | 523 |
| JBT0962 | 107 | 40 | A | Ac-FQSKGNVFVDGYFMRLRAKL-NH2 | 90 |
| JBT0964 | 28 | | | Ac-FQSKGNVFVDGYFERMRAKL-NH2 | 883 |
| JBT0966 | 100 | | A | Ac-FQSKGNVFVDGYFERLRMKL-NH2 | 91 |
| JBT0969 | 65 | | D | Ac-NQSKGNVFVDGYFERLRAKL-NH2 | 524 |
| JBT0970 | 7 | | D | Ac-FNSKGNVFVDGYFERLRAKL-NH2 | 525 |
| JBT0971 | 83 | | C | Ac-FQNKGNVFVDGYFERLRAKL-NH2 | 315 |
| JBT0972 | 94 | | C | Ac-FQSNGNVFVDGYFERLRAKL-NH2 | 316 |
| JBT0973 | | 37 | A | Ac-FQSKGNVFVDGYFERL-Cha-AKL-NH2 | 92 |
| JBT0974 | 29 | | | Ac-FQSKGNNFVDGYFERLRAKL-NH2 | 884 |
| JBT0975 | -3 | | | Ac-FQSKGNVNVDGYFERLRAKL-NH2 | 885 |
| JBT0976 | -2 | | | Ac-FQSKGNVFNDGYFERLRAKL-NH2 | 886 |
| JBT0977 | 15 | | | Ac-FQSKGNVFVDNYFERLRAKL-NH2 | 887 |
| JBT0978 | -10 | | | Ac-FQSKGNVFVDGNFERLRAKL-NH2 | 888 |

FIG. 32T

| Object ID | % Inhibition (relative to JBT-0477) | IC50 Mean (nM) | Affinity Class | Sequence | SEQ ID NO: |
|---|---|---|---|---|---|
| JBT0979 | 44 | | D | Ac-FQSKGNVFVDGYNERLRAKL-NH2 | 526 |
| JBT0980 | 93 | 40 | A | Ac-FQSKGNVFVDGYFNRLRAKL-NH2 | 93 |
| JBT0982 | -2 | | | Ac-FQSKGNVFVDGYFERNRAKL-NH2 | 889 |
| JBT0983 | 81 | | C | Ac-FQSKGNVFVDGYFERLNAKL-NH2 | 317 |
| JBT0984 | 100 | 34 | A | Ac-FQSKGNVFVDGYFERLRNKL-NH2 | 94 |
| JBT0985 | 4 | | | Ac-FQSKGNVFVDGYFERLRANL-NH2 | 890 |
| JBT0986 | 32 | | F | Ac-FQSKGNVFVDGYFERLRAKN-NH2 | 733 |
| JBT0987 | 27 | | | Ac-PQSKGNVFVDGYFERLRAKL-NH2 | 891 |
| JBT0988 | 0 | | | Ac-FPSKGNVFVDGYFERLRAKL-NH2 | 892 |
| JBT0989 | 5 | | | Ac-FQPKGNVFVDGYFERLRAKL-NH2 | 893 |
| JBT0990 | 106 | 33 | A | Ac-FQSPGNVFVDGYFERLRAKL-NH2 | 95 |
| JBT0991 | 5 | | | Ac-FQSKGPVFVDGYFERLRAKL-NH2 | 894 |
| JBT0992 | 65 | | D | Ac-FQSKGNPFVDGYFERLRAKL-NH2 | 527 |
| JBT0993 | 1 | | | Ac-FQSKGNVPVDGYFERLRAKL-NH2 | 895 |
| JBT0994 | 2 | | | Ac-FQSKGNVFPDGYFERLRAKL-NH2 | 896 |
| JBT0995 | 4 | | D | Ac-FQSKGNVFVDPYFERLRAKL-NH2 | 528 |
| JBT0996 | 3 | | | Ac-FQSKGNVFVDGPFERLRAKL-NH2 | 897 |
| JBT0997 | 8 | | D | Ac-FQSKGNVFVDGYPERLRAKL-NH2 | 529 |
| JBT0998 | 48 | | D | Ac-FQSKGNVFVDGYFPRLRAKL-NH2 | 530 |
| JBT0999 | 3 | | D | Ac-FQSKGNVFVDGYFEPLRAKL-NH2 | 531 |
| JBT1000 | 3 | | | Ac-FQSKGNVFVDGYFERPRAKL-NH2 | 898 |
| JBT1001 | 1 | | | Ac-FQSKGNVFVDGYFERLPAKL-NH2 | 899 |
| JBT1002 | 15 | | | Ac-FQSKGNVFVDGYFERLRPKL-NH2 | 900 |
| JBT1003 | 4 | | | Ac-FQSKGNVFVDGYFERLRAPL-NH2 | 901 |
| JBT1004 | 8 | | | Ac-FQSKGNVFVDGYFERLRAKP-NH2 | 902 |
| JBT1005 | 55 | | D | Ac-QQSKGNVFVDGYFERLRAKL-NH2 | 532 |
| JBT1006 | | 28 | A | Ac-FQSKGNVFVDGYFERL-Hle-AKL-NH2 | 96 |

FIG. 32U

| Object ID | % Inhibition (relative to JBT-0477) | IC50 Mean (nM) | Affinity Class | Sequence | SEQ ID NO: |
|---|---|---|---|---|---|
| JBT1007 | 98 | 28 | A | Ac-FQQKGNVFVDGYFERLRAKL-NH2 | 97 |
| JBT1008 | 83 | | C | Ac-FQSQGNVFVDGYFERLRAKL-NH2 | 318 |
| JBT1009 | 99 | 38 | A | Ac-FQSKGQVFVDGYFERLRAKL-NH2 | 98 |
| JBT1010 | 46 | | D | Ac-FQSKGNQFVDGYFERLRAKL-NH2 | 533 |
| JBT1011 | 8 | | | Ac-FQSKGNVQVDGYFERLRAKL-NH2 | 903 |
| JBT1012 | 14 | | D | Ac-FQSKGNVFQDGYFERLRAKL-NH2 | 534 |
| JBT1013 | 23 | | D | Ac-FQSKGNVFVDQYFERLRAKL-NH2 | 535 |
| JBT1014 | 4 | | | Ac-FQSKGNVFVDGQFERLRAKL-NH2 | 904 |
| JBT1015 | 55 | | D | Ac-FQSKGNVFVDGYQERLRAKL-NH2 | 536 |
| JBT1016 | 102 | 27 | A | Ac-FQSKGNVFVDGYFQRLRAKL-NH2 | 99 |
| JBT1017 | 8 | | D | Ac-FQSKGNVFVDGYFEQLRAKL-NH2 | 537 |
| JBT1018 | 12 | | | Ac-FQSKGNVFVDGYFERQRAKL-NH2 | 905 |
| JBT1019 | 76 | | D | Ac-FQSKGNVFVDGYFERLQAKL-NH2 | 538 |
| JBT1020 | 88 | | C | Ac-FQSKGNVFVDGYFERLRQKL-NH2 | 319 |
| JBT1021 | 2 | | | Ac-FQSKGNVFVDGYFERLRAQL-NH2 | 906 |
| JBT1022 | 55 | | D | Ac-FQSKGNVFVDGYFERLRAKQ-NH2 | 539 |
| JBT1023 | 60 | | D | Ac-RQSKGNVFVDGYFERLRAKL-NH2 | 540 |
| JBT1024 | 11 | | D | Ac-FRSKGNVFVDGYFERLRAKL-NH2 | 541 |
| JBT1025 | 93 | 46 | A | Ac-FQRKGNVFVDGYFERLRAKL-NH2 | 100 |
| JBT1026 | 102 | 38 | A | Ac-FQSRGNVFVDGYFERLRAKL-NH2 | 101 |
| JBT1027 | 110 | 29 | A | Ac-FQSKGRVFVDGYFERLRAKL-NH2 | 102 |
| JBT1028 | 15 | | D | Ac-FQSKGNRFVDGYFERLRAKL-NH2 | 542 |
| JBT1029 | 18 | | D | Ac-FQSKGNVRVDGYFERLRAKL-NH2 | 543 |
| JBT1030 | 18 | | D | Ac-FQSKGNVFRDGYFERLRAKL-NH2 | 544 |
| JBT1031 | 27 | | | Ac-FQSKGNVFVDRYFERLRAKL-NH2 | 907 |
| JBT1032 | 6 | | | Ac-FQSKGNVFVDGRFERLRAKL-NH2 | 908 |
| JBT1033 | 60 | | D | Ac-FQSKGNVFVDGYRERLRAKL-NH2 | 545 |

FIG. 32V

| Object ID | % Inhibition (relative to JBT-0477) | IC50 Mean (nM) | Affinity Class | Sequence | SEQ ID NO: |
|---|---|---|---|---|---|
| JBT1034 | 103 | 36 | A | Ac-FQSKGNVFVDGYFRRLRAKL-NH2 | 103 |
| JBT1035 | | 92 | B | Ac-FQSK-Nmg-AVFVAGYFARL-Nle-AKL-NH2 | 218 |
| JBT1036 | 29 | | D | Ac-FQSKGNVFVDGYFERRRAKL-NH2 | 546 |
| JBT1037 | | 27 | A | Ac-FQSKGNVFVDGYFERL-Nle-AKL-NH2 | 104 |
| JBT1038 | 107 | | A | Ac-FQSKGNVFVDGYFERLRRKL-NH2 | 105 |
| JBT1039 | 95 | | C | Ac-FQSKGNVFVDGYFERLRARL-NH2 | 320 |
| JBT1040 | 84 | | C | Ac-FQSKGNVFVDGYFERLRAKR-NH2 | 321 |
| JBT1041 | 37 | | F | Ac-SQSKGNVFVDGYFERLRAKL-NH2 | 734 |
| JBT1042 | 2 | | D | Ac-FSSKGNVFVDGYFERLRAKL-NH2 | 547 |
| JBT1043 | | 40 | A | Ac-FQSKaNVFVDGYFERL-Nle-AKL-NH2 | 106 |
| JBT1044 | 78 | | D | Ac-FQSSGNVFVDGYFERLRAKL-NH2 | 548 |
| JBT1045 | 109 | 50 | A | Ac-FQSKGSVFVDGYFERLRAKL-NH2 | 107 |
| JBT1046 | 57 | | D | Ac-FQSKGNSFVDGYFERLRAKL-NH2 | 549 |
| JBT1047 | 5 | | | Ac-FQSKGNVSVDGYFERLRAKL-NH2 | 909 |
| JBT1048 | 38 | | D | Ac-FQSKGNVFSDGYFERLRAKL-NH2 | 550 |
| JBT1049 | 18 | | D | Ac-FQSKGNVFVDSYFERLRAKL-NH2 | 551 |
| JBT1050 | 2 | | | Ac-FQSKGNVFVDGSFERLRAKL-NH2 | 910 |
| JBT1051 | 47 | | D | Ac-FQSKGNVFVDGYSERLRAKL-NH2 | 552 |
| JBT1052 | 84 | | C | Ac-FQSKGNVFVDGYFSRLRAKL-NH2 | 322 |
| JBT1053 | -7 | | | Ac-FQSKGNVFVDGYFESLRAKL-NH2 | 911 |
| JBT1054 | 1 | | | Ac-FQSKGNVFVDGYFERSRAKL-NH2 | 912 |
| JBT1055 | 78 | | D | Ac-FQSKGNVFVDGYFERLSAKL-NH2 | 553 |
| JBT1056 | 78 | | D | Ac-FQSKGNVFVDGYFERLRSKL-NH2 | 554 |
| JBT1057 | -9 | | | Ac-FQSKGNVFVDGYFERLRASL-NH2 | 913 |
| JBT1058 | 58 | | D | Ac-FQSKGNVFVDGYFERLRAKS-NH2 | 555 |
| JBT1059 | 69 | | D | Ac-TQSKGNVFVDGYFERLRAKL-NH2 | 556 |
| JBT1060 | -1 | | | Ac-FTSKGNVFVDGYFERLRAKL-NH2 | 914 |

FIG. 32W

| Object ID | % Inhibition (relative to JBT-0477) | IC50 Mean (nM) | Affinity Class | Sequence | SEQ ID NO: |
|---|---|---|---|---|---|
| JBT1061 | 73 | | D | Ac-FQTKGNVFVDGYFERLRAKL-NH2 | 557 |
| JBT1062 | 51 | | D | Ac-FQSTGNVFVDGYFERLRAKL-NH2 | 558 |
| JBT1063 | 72 | | D | Ac-FQSKGTVFVDGYFERLRAKL-NH2 | 559 |
| JBT1064 | 49 | | D | Ac-FQSKGNTFVDGYFERLRAKL-NH2 | 560 |
| JBT1065 | -12 | | | Ac-FQSKGNVTVDGYFERLRAKL-NH2 | 915 |
| JBT1066 | 24 | | D | Ac-FQSKGNVFTDGYFERLRAKL-NH2 | 561 |
| JBT1067 | -2 | | | Ac-FQSKGNVFVDTYFERLRAKL-NH2 | 916 |
| JBT1068 | -10 | | | Ac-FQSKGNVFVDGTFERLRAKL-NH2 | 917 |
| JBT1069 | 46 | | D | Ac-FQSKGNVFVDGYTERLRAKL-NH2 | 562 |
| JBT1070 | 97 | | A | Ac-FQSKGNVFVDGYFTRLRAKL-NH2 | 108 |
| JBT1071 | -9 | | | Ac-FQSKGNVFVDGYFETLRAKL-NH2 | 918 |
| JBT1072 | 9 | | | Ac-FQSKGNVFVDGYFERTRAKL-NH2 | 919 |
| JBT1073 | 82 | | C | Ac-FQSKGNVFVDGYFERLTAKL-NH2 | 323 |
| JBT1074 | 71 | | D | Ac-FQSKGNVFVDGYFERLRTKL-NH2 | 563 |
| JBT1075 | -15 | | | Ac-FQSKGNVFVDGYFERLRATL-NH2 | 920 |
| JBT1076 | 69 | | D | Ac-FQSKGNVFVDGYFERLRAKT-NH2 | 564 |
| JBT1077 | 81 | | C | Ac-VQSKGNVFVDGYFERLRAKL-NH2 | 324 |
| JBT1078 | -3 | | | Ac-FVSKGNVFVDGYFERLRAKL-NH2 | 921 |
| JBT1079 | 93 | | C | Ac-FQVKGNVFVDGYFERLRAKL-NH2 | 325 |
| JBT1080 | 92 | | C | Ac-FQSVGNVFVDGYFERLRAKL-NH2 | 326 |
| JBT1081 | 95 | | C | Ac-FQSKGVVFVDGYFERLRAKL-NH2 | 327 |
| JBT1082 | | 250 | D | Ac-FQSKaAVFVFGYFARLRAKL-NH2 | 565 |
| JBT1083 | 17 | | | Ac-FQSKGNVVVDGYFARLRAKL-NH2 | 922 |
| JBT1084 | | 45 | A | Ac-FQSK-Nmg-AVFVAGYFARLRAKL-NH2 | 109 |
| JBT1085 | -10 | | | Ac-FQSKGNVFVDVYFERLRAKL-NH2 | 923 |
| JBT1086 | -15 | | | Ac-FQSKGNVFVDGVFERLRAKL-NH2 | 924 |
| JBT1087 | 40 | | D | Ac-FQSKGNVFVDGYVERLRAKL-NH2 | 566 |

FIG. 32X

| Object ID | % Inhibition (relative to JBT-0477) | IC50 Mean (nM) | Affinity Class | Sequence | SEQ ID NO: |
|---|---|---|---|---|---|
| JBT1088 | 99 | | A | Ac-FQSKGNVFVDGYFVRLRAKL-NH2 | 110 |
| JBT1089 | -4 | | | Ac-FQSKGNVFVDGYFEVLRAKL-NH2 | 925 |
| JBT1090 | 37 | | D | Ac-FQSKGNVFVDGYFERVRAKL-NH2 | 567 |
| JBT1091 | 91 | 53 | B | Ac-FQSKGNVFVDGYFERLVAKL-NH2 | 219 |
| JBT1092 | 85 | | C | Ac-FQSKGNVFVDGYFERLRVKL-NH2 | 328 |
| JBT1093 | 6 | | | Ac-FQSKGNVFVDGYFERLRAVL-NH2 | 926 |
| JBT1094 | 68 | | D | Ac-FQSKGNVFVDGYFERLRAKV-NH2 | 568 |
| JBT1095 | 92 | | C | Ac-WQSKGNVFVDGYFERLRAKL-NH2 | 329 |
| JBT1096 | -3 | | | Ac-FWSKGNVFVDGYFERLRAKL-NH2 | 927 |
| JBT1097 | 55 | | D | Ac-FQWKGNVFVDGYFERLRAKL-NH2 | 569 |
| JBT1099 | 58 | | D | Ac-FQSKGWVFVDGYFERLRAKL-NH2 | 570 |
| JBT1100 | 45 | | D | Ac-FQSKGNWFVDGYFERLRAKL-NH2 | 571 |
| JBT1101 | 55 | | D | Ac-FQSKGNVWVDGYFERLRAKL-NH2 | 572 |
| JBT1102 | 4 | | D | Ac-FQSKGNVFWDGYFERLRAKL-NH2 | 573 |
| JBT1103 | 15 | | D | Ac-FQSKGNVFVDWYFERLRAKL-NH2 | 574 |
| JBT1104 | 0 | | | Ac-FQSKGNVFVDGWFERLRAKL-NH2 | 928 |
| JBT1105 | 85 | | C | Ac-FQSKGNVFVDGYWERLRAKL-NH2 | 330 |
| JBT1106 | 82 | 59 | B | Ac-FQSKGNVFVDGYFWRLRAKL-NH2 | 220 |
| JBT1107 | -7 | | | Ac-FQSKGNVFVDGYFEWLRAKL-NH2 | 929 |
| JBT1108 | 9 | | D | Ac-FQSKGNVFVDGYFERWRAKL-NH2 | 575 |
| JBT1109 | 78 | | D | Ac-FQSKGNVFVDGYFERLWAKL-NH2 | 576 |
| JBT1110 | 93 | | C | Ac-FQSKGNVFVDGYFERLRWKL-NH2 | 331 |
| JBT1111 | -6 | | | Ac-FQSKGNVFVDGYFERLRAWL-NH2 | 930 |
| JBT1112 | 87 | | C | Ac-FQSKGNVFVDGYFERLRAKW-NH2 | 332 |
| JBT1113 | 101 | | A | Ac-YQSKGNVFVDGYFERLRAKL-NH2 | 111 |
| JBT1114 | 12 | | | Ac-FYSKGNVFVDGYFERLRAKL-NH2 | 931 |
| JBT1115 | 75 | | D | Ac-FQYKGNVFVDGYFERLRAKL-NH2 | 577 |

FIG. 32Y

| Object ID | % Inhibition (relative to JBT-0477) | IC50 Mean (nM) | Affinity Class | Sequence | SEQ ID NO: |
|---|---|---|---|---|---|
| JBT1117 | 83 | | C | Ac-FQSKGYVFVDGYFERLRAKL-NH2 | 333 |
| JBT1118 | 82 | | C | Ac-FQSKGNYFVDGYFERLRAKL-NH2 | 334 |
| JBT1119 | 99 | | A | Ac-FQSKGNVYVDGYFERLRAKL-NH2 | 112 |
| JBT1120 | 11 | | D | Ac-FQSKGNVFYDGYFERLRAKL-NH2 | 578 |
| JBT1121 | 12 | | | Ac-FQSKGNVFVDYYFERLRAKL-NH2 | 932 |
| JBT1122 | | 33 | A | Ac-FQSK-Nmg-NVFVDGYFARL-Nle-AKL-NH2 | 113 |
| JBT1123 | 84 | | C | Ac-FQSKGNVFVDGYYERLRAKL-NH2 | 335 |
| JBT1124 | 85 | | C | Ac-FQSKGNVFVDGYFYRLRAKL-NH2 | 336 |
| JBT1125 | 8 | | | Ac-FQSKGNVFVDGYFEYLRAKL-NH2 | 933 |
| JBT1126 | 11 | | | Ac-FQSKGNVFVDGYFERYRAKL-NH2 | 934 |
| JBT1127 | 92 | | C | Ac-FQSKGNVFVDGYFERLYAKL-NH2 | 337 |
| JBT1128 | 65 | | D | Ac-FQSKGNVFVDGYFERLRYKL-NH2 | 579 |
| JBT1129 | -7 | | | Ac-FQSKGNVFVDGYFERLRAYL-NH2 | 935 |
| JBT1130 | 76 | | D | Ac-FQSKGNVFVDGYFERLRAKY-NH2 | 580 |
| JBT1132 | | 20 | A | Fam-FQSKGNVFVDGYFERLRAKL-NH2 | 114 |
| JBT1133 | | 31 | A | Ac-FQSKkAVFVDGYFARLRAKL-NH2 | 115 |
| JBT1134 | | 39 | A | Ac-FQSKGAVFVDGYFARLRAKL-NH2 | 116 |
| JBT1135 | | 82 | B | Ac-FQSKDAVFVDGYFARLRAKL-NH2 | 221 |
| JBT1136 | | 40 | A | Ac-FQSKdAVFVDGYFARLRAKL-NH2 | 117 |
| JBT1137 | | 40 | A | Ac-FQSKkAVFVAGYFARLRAKL-NH2 | 118 |
| JBT1138 | | 64 | B | Ac-FQSKGAVFVAGYFARLRAKL-NH2 | 222 |
| JBT1139 | | 87 | B | Ac-FQSKDAVFVAGYFARLRAKL-NH2 | 223 |
| JBT1140 | | 36 | A | Ac-FQSKdAVFVAGYFARLRAKL-NH2 | 119 |
| JBT1141 | | 34 | A | Ac-FQSKkAVFVKGYFARLRAKL-NH2 | 120 |
| JBT1142 | | 53 | B | Ac-FQSKGAVFVKGYFARLRAKL-NH2 | 224 |
| JBT1143 | | 58 | B | Ac-FQSKDAVFVKGYFARLRAKL-NH2 | 225 |
| JBT1144 | | 34 | A | Ac-FQSKdAVFVKGYFARLRAKL-NH2 | 121 |

FIG. 32Z

| Object ID | % Inhibition (relative to JBT-0477) | IC50 Mean (nM) | Affinity Class | Sequence | SEQ ID NO: |
|---|---|---|---|---|---|
| JBT1145 | | 45 | A | Ac-FQSKkAVFVTGYFARLRAKL-NH2 | 122 |
| JBT1146 | | 65 | B | Ac-FQSKGAVFVTGYFARLRAKL-NH2 | 226 |
| JBT1147 | | 95 | B | Ac-FQSKDAVFVTGYFARLRAKL-NH2 | 227 |
| JBT1148 | | 46 | A | Ac-FQSKdAVFVTGYFARLRAKL-NH2 | 123 |
| JBT1149 | | >5000 | | Ac-FQSKGNVFvFGYFARLRAKL-NH2 | 936 |
| JBT1150 | | 1154 | E | Ac-FQSKaNVFVTGYFERL-Nle-AKL-NH2 | 704 |
| JBT1151 | | >5000 | | Ac-FQSKKNVFVFGYFERLRAKD-NH2 | 937 |
| JBT1152 | | 4119 | F | Ac-FQSKKNVFFFGYFERLRAKL-NH2 | 735 |
| JBT1153 | | 1294 | E | Ac-FQSKKNVFVFGYFERLGAKL-NH2 | 705 |
| JBT1154 | | 27 | A | Fam-Ttds-FQSKGNVFVDGYFERLRAKL-NH2 | 124 |
| JBT1155 | | 31 | A | Ac-FQSK-Nmg-NVFVTGYFERLRAKL-NH2 | 125 |
| JBT1156 | | 41 | A | Ac-FQSKaNVFVDGYFARL-Nle-AKL-NH2 | 126 |
| JBT1157 | | 34 | A | Ac-FQSKaNVFVAGYFARLRAKL-NH2 | 127 |
| JBT1158 | | 51 | B | Ac-FQSKGNVFVFGYFERLRAKL-N-methyl | 228 |
| JBT1159 | | 38 | A | Ac-FQSKGNVFVFGYFERLRAKL-N-ethyl | 128 |
| JBT1161 | | 122 | C | Ac-FQSK-Aib-NVFVFGYFERLRAKL-NH2 | 338 |
| JBT1162 | | 28 | A | Ac-FQSKpNVFVFGYFERLRAKL-NH2 | 129 |
| JBT1164 | 70 | 28 | A | Ac-FQSKGNVFVDGYFERLRAKLC-NH2 | 130 |
| JBT1166 | 57 | 129 | C | Ac-FQSKANVFVDGYFERLRAKL-NH2 | 339 |
| JBT1167 | 86 | | D | Ac-FQSKENVFVDGYFERLRAKL-NH2 | 581 |
| JBT1168 | 70 | 94 | B | Ac-FQSKFNVFVDGYFERLRAKL-NH2 | 229 |
| JBT1169 | 37 | 127 | C | Ac-FQSKHNVFVDGYFERLRAKL-NH2 | 340 |
| JBT1170 | 81 | | D | Ac-FQSKINVFVDGYFERLRAKL-NH2 | 582 |
| JBT1171 | 11 | | C | Ac-FQSKLNVFVDGYFERLRAKL-NH2 | 341 |
| JBT1173 | 83 | | D | Ac-FQSKPNVFVDGYFERLRAKL-NH2 | 583 |
| JBT1174 | | 115 | C | Ac-FQSKRNVFVDGYFERLRAKL-NH2 | 342 |
| JBT1175 | 63 | | D | Ac-FQSKSNVFVDGYFERLRAKL-NH2 | 584 |

FIG. 32AA

| Object ID | % Inhibition (relative to JBT-0477) | IC50 Mean (nM) | Affinity Class | Sequence | SEQ ID NO: |
|---|---|---|---|---|---|
| JBT1176 | 79 | | D | Ac-FQSKTNVFVDGYFERLRAKL-NH2 | 585 |
| JBT1177 | 61 | | D | Ac-FQSKVNVFVDGYFERLRAKL-NH2 | 586 |
| JBT1178 | 54 | | D | Ac-FQSKWNVFVDGYFERLRAKL-NH2 | 587 |
| JBT1179 | 86 | 100 | C | Ac-FQSKYNVFVDGYFERLRAKL-NH2 | 343 |
| JBT1180 | 101 | 98 | B | Ac-FQSKGNVFVAGYFERLRAKL-NH2 | 230 |
| JBT1181 | 86 | 107 | C | Ac-FQSKGNVFVGGYFERLRAKL-NH2 | 344 |
| JBT1182 | 71 | | D | Ac-FQSKGNVFVIGYFERLRAKL-NH2 | 588 |
| JBT1183 | 52 | | D | Ac-FQSKGNVFVLGYFERLRAKL-NH2 | 589 |
| JBT1184 | 97 | 52 | B | Ac-FQSKGNVFVMGYFERLRAKL-NH2 | 231 |
| JBT1185 | 105 | 50 | B | Ac-FQSKGNVFVPGYFERLRAKL-NH2 | 232 |
| JBT1186 | 60 | | D | Ac-FQSKGNVFVQGYFERLRAKL-NH2 | 590 |
| JBT1188 | 104 | | A | Ac-FQSKGNVFVSGYFERLRAKL-NH2 | 131 |
| JBT1189 | 124 | 48 | A | Ac-FQSKGNVFVWGYFERLRAKL-NH2 | 132 |
| JBT1190 | 116 | 101 | C | Ac-FQSKGNVFVYGYFERLRAKL-NH2 | 345 |
| JBT1191 | 112 | 158 | C | Ac-FQSKGNVFVYGYFERLRAKL-NH2 | 346 |
| JBT1192 | 81 | 113 | C | Ac-FQSKANVFVDGYFERLAAKL-NH2 | 347 |
| JBT1193 | 73 | | D | Ac-FQSKFNVFVDGYFERLAAKL-NH2 | 591 |
| JBT1194 | 65 | | D | Ac-FQSKYNVFVDGYFHERLAAKL-NH2 | 592 |
| JBT1195 | 44 | | D | Ac-FQSSHNVFVDGYFERLAAKL-NH2 | 593 |
| JBT1196 | 85 | | C | Ac-FQSRENVFVDGYFERLAAKL-NH2 | 348 |
| JBT1197 | 100 | 63 | B | Ac-FQSKGNVFVDGYFMRLAAKL-NH2 | 233 |
| JBT1198 | 60 | | D | Ac-FQSAKNVFVDGYFERLRAKL-NH2 | 594 |
| JBT1199 | 62 | | D | Ac-FQSFKNVFVDGYFERLAAKL-NH2 | 595 |
| JBT1200 | 53 | 226 | C | Ac-FQSKDNVFVHGYFERLAAKL-NH2 | 349 |
| JBT1201 | 44 | | D | Ac-FQDPKNVFVDGYFERLAAKL-NH2 | 596 |
| JBT1202 | 34 | | D | Ac-FQSKVNVFVDGYFERLAAKL-NH2 | 597 |
| JBT1203 | 50 | | D | Ac-FQSIKNVFVDGYFERLAAKL-NH2 | 598 |

FIG. 32AB

| Object ID | % Inhibition (relative to JBT-0477) | IC50 Mean (nM) | Affinity Class | Sequence | SEQ ID NO: |
|---|---|---|---|---|---|
| JBT1204 | 106 | 98 | B | Ac-YQSKNNVFVDGYFERLAAKL-NH2 | 234 |
| JBT1205 | 85 | 128 | C | Ac-FQSKERVFVDGYFERLAAKL-NH2 | 350 |
| JBT1206 | 104 | 74 | B | Ac-FQSKGHVFVDGYFERLAAKL-NH2 | 235 |
| JBT1207 | 48 | | D | Ac-FQSKTNIFVDGYFERLAAKL-NH2 | 599 |
| JBT1208 | 37 | | D | Ac-FQSHYNVFVDGYFERLAAKL-NH2 | 600 |
| JBT1209 | 32 | | D | Ac-FQSKENVFVDGYFDRLAAKL-NH2 | 601 |
| JBT1210 | 61 | 137 | C | Ac-FQSKQNVFVDGYFERLAIKL-NH2 | 351 |
| JBT1211 | 79 | 105 | C | Ac-FQSKYNVFVDGYFERLAVKL-NH2 | 352 |
| JBT1212 | 86 | | C | Ac-FQSRNNVFVDGYFERLAAKL-NH2 | 353 |
| JBT1213 | 64 | 122 | C | Ac-FQSRQNVFVDGYFERLAAKL-NH2 | 354 |
| JBT1214 | 64 | 132 | C | Ac-FQSKQNVFVDGYFERLAAKL-NH2 | 355 |
| JBT1215 | 72 | 171 | C | Ac-FQSSKNVFVDGYFERLAAKL-NH2 | 356 |
| JBT1216 | 70 | 117 | C | Ac-FQSKENVFVDGYFERLAAKL-NH2 | 357 |
| JBT1217 | 63 | | D | Ac-FQSHHNVFVDGYFERLAAKL-NH2 | 602 |
| JBT1218 | 72 | | D | Ac-FQSYKNVFVDGYFERLAAKL-NH2 | 603 |
| JBT1219 | 76 | 90 | B | Ac-FQSKKNVFVDGYFERLAAKL-NH2 | 236 |
| JBT1220 | 85 | 85 | B | Ac-FQTKHNVFVDGYFERLAAKL-NH2 | 237 |
| JBT1221 | 67 | | D | Ac-FQSKHNVFVDGYFERLAFKL-NH2 | 604 |
| JBT1222 | 85 | 82 | B | Ac-FQSKYNVFVDGYFERLAAKL-NH2 | 238 |
| JBT1223 | 54 | | D | Ac-FQSFKHVFVDGYFERLAAKL-NH2 | 605 |
| JBT1224 | 57 | | D | Ac-FQSKANVHVDGYFERLAAKL-NH2 | 606 |
| JBT1225 | 77 | 107 | C | Ac-FQSKDNVFVDGYFERLAAKL-NH2 | 358 |
| JBT1226 | 26 | | | Ac-LQSKTNVFVDGYFERLAAKL-NH2 | 938 |
| JBT1227 | 99 | 76 | B | Ac-FQSKNNVFVDGYFERLAAKL-NH2 | 239 |
| JBT1228 | 99 | 55 | B | Ac-FQSKDHVFVDGYFERLAAKL-NH2 | 240 |
| JBT1229 | 93 | 92 | B | Ac-FQSKHNVFVDGYFERLARKL-NH2 | 241 |
| JBT1230 | 52 | | D | Ac-FQSKSNVFVDGYFERLAAKL-NH2 | 607 |

FIG. 32AC

| Object ID | % Inhibition (relative to JBT-0477) | IC50 Mean (nM) | Affinity Class | Sequence | SEQ ID NO: |
|---|---|---|---|---|---|
| JBT1231 | 68 | 92 | B | Ac-FQSKHNVFVDGYFERLAAKL-NH2 | 242 |
| JBT1232 | 47 | | D | Ac-FQSHKNVFVDGYFERLAAKL-NH2 | 608 |
| JBT1233 | 11 | | | Ac-FQSKFNVFVDGYTERLAAKL-NH2 | 939 |
| JBT1234 | 63 | | D | Ac-FQSKDNVFVDGYFERLAAKF-NH2 | 609 |
| JBT1235 | 65 | | D | Ac-FQSKMNVFVDGYFERLAAKL-NH2 | 610 |
| JBT1236 | 41 | | E | Ac-FQSVKNVFVDGYFERLAAKL-NH2 | 706 |
| JBT1238 | 14 | | | Ac-FQSKHNVFVDGHFERLAAKL-NH2 | 940 |
| JBT1240 | 61 | | D | Ac-FQSAYNVFVDGYFERLAAKL-NH2 | 611 |
| JBT1241 | 53 | | D | Ac-FQSKGNWFVDGYFERLAAKL-NH2 | 612 |
| JBT1242 | 49 | | E | Ac-FQSKVAVFVDGYFERLAAKL-NH2 | 707 |
| JBT1243 | 59 | | D | Ac-FQSAKNVFVDGYFVRLRAKL-NH2 | 613 |
| JBT1244 | 62 | | D | Ac-FQSKTNVFVDGYFERLAAKL-NH2 | 614 |
| JBT1245 | 34 | | F | Ac-FQSKKDVFVDGYFERLAAKL-NH2 | 736 |
| JBT1246 | 68 | | D | Ac-FQSKHVVFVDGYFERLAAKL-NH2 | 615 |
| JBT1247 | 39 | | F | Ac-FQSKSNVFVDGYFERLAARL-NH2 | 737 |
| JBT1248 | 6 | | | Ac-FQSVHNVFVDGYFERPAAKL-NH2 | 941 |
| JBT1249 | 7 | | | Ac-FQSKYNVFVDEYFERLAARL-NH2 | 942 |
| JBT1250 | 66 | 216 | C | Ac-FQSKDNVFVDGYFERLAARL-NH2 | 359 |
| JBT1251 | 60 | | D | Ac-FQSKKHVFVDGYFERLAAKL-NH2 | 616 |
| JBT1252 | 37 | | F | Ac-FQSTKNVFVDGYFERLAAKL-NH2 | 738 |
| JBT1253 | 30 | | D | Ac-FQSDKNVFVDGYFERLAAKL-NH2 | 617 |
| JBT1254 | 93 | 47 | A | Ac-FQSKHHVFVDGYFERLAAKL-NH2 | 133 |
| JBT1255 | 41 | | D | Ac-FQSNKNVFVDGYFERLAAKL-NH2 | 618 |
| JBT1256 | 88 | 125 | C | Ac-FQSKHNVYVDGYFERLAAKL-NH2 | 360 |
| JBT1257 | 40 | | D | Ac-FQSHKNVFVEGYFERLAAKL-NH2 | 619 |
| JBT1258 | 13 | | | Ac-FQSKPNVFVDGYFERLAAKL-NH2 | 943 |
| JBT1259 | 23 | | D | Ac-FQSYKDVFVDGYFERLATKL-NH2 | 620 |

FIG. 32AD

| Object ID | % Inhibition (relative to JBT-0477) | IC50 Mean (nM) | Affinity Class | Sequence | SEQ ID NO: |
|---|---|---|---|---|---|
| JBT1260 | 113 | 50 | A | Ac-FQSRRGVFVDGYFERLAAKL-NH2 | 134 |
| JBT1261 | 81 | 98 | B | Ac-FQSKLNVFVDGYFERLAAKL-NH2 | 243 |
| JBT1262 | 15 |  | D | Ac-FQSKNNFFVDGYFERLAARL-NH2 | 621 |
| JBT1263 | 78 | 152 | C | Ac-FQSKYNIFVDGYFERLAAKL-NH2 | 361 |
| JBT1264 | 39 |  | F | Ac-YQSKQNVFVDGYFERLAAKL-NH2 | 739 |
| JBT1265 | 58 |  | D | Ac-FQSEQNVFVDGYFERLAAKL-NH2 | 622 |
| JBT1266 | 53 |  | D | Ac-FQSEHNVFVDGYFERLAAKL-NH2 | 623 |
| JBT1267 | 55 | 219 | C | Ac-FQSKNDVFVDGYFERLAAKL-NH2 | 362 |
| JBT1268 | -8 |  |  | Ac-HQQFKNVFVDGYFERLAAKL-NH2 | 944 |
| JBT1269 | 58 | 155 | C | Ac-FQSGGNVFVDGYFERLAAKL-NH2 | 363 |
| JBT1270 | 61 |  | D | Ac-FQSEKNVFVDGYFERLAAKL-NH2 | 624 |
| JBT1271 | 21 |  | D | Ac-FQSKKNVFVDGYFERLAAKL-NH2 | 625 |
| JBT1272 | 58 |  | D | Ac-FQSKRNVFVDGYFERLAFKL-NH2 | 626 |
| JBT1273 | 74 | 106 | C | Ac-FQSPKNVFVDGYFERLAAKL-NH2 | 364 |
| JBT1274 | 28 |  | D | Ac-FQSGKNVFVDGYFERLAAKL-NH2 | 627 |
| JBT1275 | 68 | 123 | C | Ac-FQSPKNVFVDGYFERLRAKL-NH2 | 365 |
| JBT1277 | -4 |  |  | Ac-FQSKHNVFVDAYFERLRAKL-NH2 | 945 |
| JBT1278 | 74 | 73 | B | Ac-FQSVGNVFVDGYFERLSAKL-NH2 | 244 |
| JBT1279 | 13 |  | D | Ac-FQSYKNVFVDGYFERLFAKL-NH2 | 628 |
| JBT1280 | 56 | 160 | C | Ac-FQSRKNVFVDGYFERLRAKL-NH2 | 366 |
| JBT1281 | -5 |  |  | Ac-FQSKKNVFVDGYSERLRAKL-NH2 | 946 |
| JBT1282 | 52 | 176 | C | Ac-FQSKKRVFVDGYFERLRAKL-NH2 | 367 |
| JBT1283 | 36 |  | F | Ac-FQSFENVFVDGYFERLHAKL-NH2 | 740 |
| JBT1285 | 100 | 186 | C | Ac-FQSIKNVFVDGYFERLRAKL-NH2 | 368 |
| JBT1286 | 113 | 69 | B | Ac-FQSYKNVFVDGYFERLRAKL-NH2 | 245 |
| JBT1287 | 86 |  | C | Ac-CQSKGNVFVDGYFERLRAKL-NH2 | 369 |
| JBT1288 | 32 |  | D | Ac-FCSKGNVFVDGYFERLRAKL-NH2 | 629 |

FIG. 32AE

| Object ID | % Inhibition (relative to JBT-0477) | IC50 Mean (nM) | Affinity Class | Sequence | SEQ ID NO: |
|---|---|---|---|---|---|
| JBT1289 | 96 | | A | Ac-FQCKGNVFVDGYFERLRAKL-NH2 | 135 |
| JBT1290 | 64 | | D | Ac-FQSCGNVFVDGYFERLRAKL-NH2 | 630 |
| JBT1292 | 109 | 30 | A | Ac-FQSKGCVFVDGYFERLRAKL-NH2 | 136 |
| JBT1293 | 17 | | D | Ac-FQSKGNCFVDGYFERLRAKL-NH2 | 631 |
| JBT1294 | -6 | | | Ac-FQSKGNVCVDGYFERLRAKL-NH2 | 947 |
| JBT1295 | 1 | | | Ac-FQSKGNVFCDGYFERLRAKL-NH2 | 948 |
| JBT1296 | 65 | | D | Ac-FQSKGNVFVCGYFERLRAKL-NH2 | 632 |
| JBT1297 | 66 | | D | Ac-FQSKGNVFVDCYFERLRAKL-NH2 | 633 |
| JBT1298 | -20 | | | Ac-FQSKGNVFVDGCFERLRAKL-NH2 | 949 |
| JBT1299 | 111 | 28 | A | Ac-FQSKGNVFVDGYCERLRAKL-NH2 | 137 |
| JBT1300 | 113 | | A | Ac-FQSKGNVFVDGYFCRLRAKL-NH2 | 138 |
| JBT1301 | -18 | | | Ac-FQSKGNVFVDGYFECLRAKL-NH2 | 950 |
| JBT1302 | 27 | | D | Ac-FQSKGNVFVDGYFERCRAKL-NH2 | 634 |
| JBT1303 | 97 | | A | Ac-FQSKGNVFVDGYFERLCAKL-NH2 | 139 |
| JBT1304 | 85 | | C | Ac-FQSKGNVFVDGYFERLRCKL-NH2 | 370 |
| JBT1305 | -6 | | | Ac-FQSKGNVFVDGYFERLRACL-NH2 | 951 |
| JBT1306 | 65 | | D | Ac-FQSKGNVFVDGYFERLRAKC-NH2 | 635 |
| JBT1307 | 103 | | A | Ac-FQSKANVFVDGYFERLCAKL-NH2 | 140 |
| JBT1308 | 86 | | C | Ac-FQSKFNVFVDGYFERLCAKL-NH2 | 371 |
| JBT1309 | 92 | | C | Ac-FQSKYNVFVDGYHERLCAKL-NH2 | 372 |
| JBT1310 | 95 | | C | Ac-FQSSHNVFVDGYFERLCAKL-NH2 | 373 |
| JBT1311 | 83 | | C | Ac-FQSRENVFVDGYFERLCAKL-NH2 | 374 |
| JBT1312 | 99 | | A | Ac-FQSKGNVFVDGYFMRLCAKL-NH2 | 141 |
| JBT1313 | 87 | | C | Ac-FQSCKNVFVDGYFERLRAKL-NH2 | 375 |
| JBT1314 | 55 | | D | Ac-FQSFKNVFVDGYFERLCAKL-NH2 | 636 |
| JBT1315 | 95 | 35 | A | Ac-FQSKIDNVFVHGYFERLCAKL-NH2 | 142 |
| JBT1316 | 90 | | C | Ac-FQDPKNVFVDGYFERLCAKL-NH2 | 376 |

FIG. 32AF

| Object ID | % Inhibition (relative to JBT-0477) | IC50 Mean (nM) | Affinity Class | Sequence | SEQ ID NO: |
|---|---|---|---|---|---|
| JBT1317 | 76 | | D | Ac-FQSKVNVFVDGYFERLCAKL-NH2 | 637 |
| JBT1318 | 73 | | D | Ac-FQSIKNVFVDGYFERLCAKL-NH2 | 638 |
| JBT1319 | 108 | 20 | A | Ac-YQSKNNVFVDGYFERLCAKL-NH2 | 143 |
| JBT1320 | 110 | 271 | D | Ac-FQSKERVFVDGYFERLCAKL-NH2 | 639 |
| JBT1321 | 117 | 31 | A | Ac-FQSKGHVFVDGYFERLCAKL-NH2 | 144 |
| JBT1322 | 89 | | C | Ac-FQSKTNIFVDGYFERLCAKL-NH2 | 377 |
| JBT1323 | 87 | 171 | C | Ac-FQSHYNVFVDGYFERLCAKL-NH2 | 378 |
| JBT1324 | 92 | 424 | D | Ac-FQSKENVFVDGYFDRLCAKL-NH2 | 640 |
| JBT1325 | 62 | | D | Ac-FQSKQNVFVDGYFERLCIKL-NH2 | 641 |
| JBT1326 | 61 | | D | Ac-FQSKYNVFVDGYFERLCVKL-NH2 | 642 |
| JBT1328 | 93 | | C | Ac-FQSRQNVFVDGYFERLCAKL-NH2 | 379 |
| JBT1329 | 96 | 20 | A | Ac-FQSKQNVFVDGYFERLCAKL-NH2 | 145 |
| JBT1330 | 86 | | C | Ac-FQSSKNVFVDGYFERLCAKL-NH2 | 380 |
| JBT1331 | 100 | | A | Ac-FQSKENVFVDGYFERLCAKL-NH2 | 146 |
| JBT1332 | 87 | | C | Ac-FQSHHNVFVDGYFERLCAKL-NH2 | 381 |
| JBT1333 | 72 | | D | Ac-FQSYKNVFVDGYFERLCAKL-NH2 | 643 |
| JBT1334 | 103 | 23 | A | Ac-FQSKKNVFVDGYFERLCAKL-NH2 | 147 |
| JBT1335 | 111 | 247 | C | Ac-FQTKHNVFVDGYFERLCAKL-NH2 | 382 |
| JBT1336 | 61 | | D | Ac-FQSKHNVFVDGYFERLCFKL-NH2 | 644 |
| JBT1337 | 74 | | D | Ac-FQSKYNVFVDGYFERLCAKL-NH2 | 645 |
| JBT1338 | 46 | | D | Ac-FQSFKHVFVDGYFERLCAKL-NH2 | 646 |
| JBT1339 | 88 | | C | Ac-FQSKANVHVDGYFERLCAKL-NH2 | 383 |
| JBT1340 | 7 | | | Ac-FQSCKNVFVDGYFERLCAKL-NH2 | 952 |
| JBT1341 | 98 | 49 | A | Ac-FQSKDNVFVDGYFERLCAKL-NH2 | 148 |
| JBT1342 | 75 | | D | Ac-LQSKTNVFVDGYFERLCAKL-NH2 | 647 |
| JBT1343 | 99 | | A | Ac-FQSKNNVFVDGYFERLCAKL-NH2 | 149 |
| JBT1344 | 95 | | A | Ac-FQSKDHVFVDGYFERLCAKL-NH2 | 150 |

FIG. 32AG

| Object ID | % Inhibition (relative to JBT-0477) | IC50 Mean (nM) | Affinity Class | Sequence | SEQ ID NO: |
|---|---|---|---|---|---|
| JBT1345 | 91 | | C | Ac-FQSKHNVFVDGYFERLCRKL-NH2 | 384 |
| JBT1346 | 20 | | D | Ac-FQSKCNVFVDGYFERLCAKL-NH2 | 648 |
| JBT1347 | 95 | 24 | A | Ac-FQSKIINVFVDGYFERLCAKL-NH2 | 151 |
| JBT1348 | 91 | | C | Ac-FQSKSNVFVDGYFERLCAKL-NH2 | 385 |
| JBT1349 | 82 | | C | Ac-FQSHKNVFVDGYFERLCAKL-NH2 | 386 |
| JBT1350 | 35 | | D | Ac-FQSKFNVFVDGYFERLCAKL-NH2 | 649 |
| JBT1351 | 85 | | C | Ac-FQSKDNVFVDGYFERLCAKF-NH2 | 387 |
| JBT1352 | 85 | | C | Ac-FQSKMNVFVDGYFERLCAKL-NH2 | 388 |
| JBT1353 | 51 | | D | Ac-FQSVKNVFVDGYFERLCAKL-NH2 | 650 |
| JBT1354 | 86 | | C | Ac-FQSAKNVFVDGYFERLCAKL-NH2 | 389 |
| JBT1356 | 49 | | E | Ac-FQSKENVFVDGYFERLCYKL-NH2 | 708 |
| JBT1357 | 52 | | D | Ac-FQSKGNWFVDGYFERLCAKL-NH2 | 651 |
| JBT1358 | 20 | | D | Ac-FQSKVAVFVDGYFERLCAKL-NH2 | 652 |
| JBT1359 | 24 | | | Ac-FQSAYNVFVDGYFERLCAKL-NH2 | 953 |
| JBT1360 | 25 | | D | Ac-FQSCKNVFVDGYFVRLRAKL-NH2 | 653 |
| JBT1361 | 75 | | D | Ac-FQSKTNVFVDGYFERLCAKL-NH2 | 654 |
| JBT1362 | 76 | | D | Ac-FQSKKDVFVDGYFERLCAKL-NH2 | 655 |
| JBT1363 | 88 | | C | Ac-FQSKHVVFVDGYFERLCAKL-NH2 | 390 |
| JBT1364 | 64 | | D | Ac-FQSKSNVFVDGYFERLCARL-NH2 | 656 |
| JBT1365 | -4 | | | Ac-FQSVHNVFVDGYFERPCAKL-NH2 | 954 |
| JBT1366 | 21 | | | Ac-FQSKYNVFVDEYFERLCAKL-NH2 | 955 |
| JBT1367 | 83 | | C | Ac-FQSKDNVFVDGYFERLCARL-NH2 | 391 |
| JBT1368 | 89 | | C | Ac-FQSKKHVFVDGYFERLCAKL-NH2 | 392 |
| JBT1369 | 40 | | E | Ac-FQSTKNVFVDGYFERLCAKL-NH2 | 709 |
| JBT1370 | 52 | | D | Ac-FQSDKNVFVDGYFERLCAKL-NH2 | 657 |
| JBT1371 | 96 | | A | Ac-FQSKHHVFVDGYFERLCAKL-NH2 | 152 |
| JBT1372 | 83 | | C | Ac-FQSNKNVFVDGYFERLCAKL-NH2 | 393 |

FIG. 32AH

| Object ID | % Inhibition (relative to JBT-0477) | IC50 Mean (nM) | Affinity Class | Sequence | SEQ ID NO: |
|---|---|---|---|---|---|
| JBT1373 | 96 | | A | Ac-FQSKHNVYVDGYFERLCAKL-NH2 | 153 |
| JBT1374 | 71 | | D | Ac-FQSHKNVFVEGYFERLCAKL-NH2 | 658 |
| JBT1375 | 45 | | D | Ac-FQSKPNVFVDGYFERLCAKL-NH2 | 659 |
| JBT1376 | 47 | | D | Ac-FQSYKDVFVDGYFERLCTKL-NH2 | 660 |
| JBT1377 | 101 | | A | Ac-FQSRRGVFVDGYFERLCAKL-NH2 | 154 |
| JBT1378 | 70 | | D | Ac-FQSKLNVFVDGYFERLCAKL-NH2 | 661 |
| JBT1379 | 40 | | D | Ac-FQSKNNFFVDGYFERLCARL-NH2 | 662 |
| JBT1380 | 66 | | D | Ac-FQSKYNIFVDGYFERLCAKL-NH2 | 663 |
| JBT1381 | 106 | 19 | A | Ac-YQSKQNVFVDGYFERLCAKL-NH2 | 155 |
| JBT1383 | 103 | | A | Ac-FQSEHNVFVDGYFERLCAKL-NH2 | 156 |
| JBT1384 | 105 | 23 | A | Ac-FQSKNDVFVDGYFERLCAKL-NH2 | 157 |
| JBT1385 | 54 | | D | Ac-HQQFKNVFVDGYFERLCAKL-NH2 | 664 |
| JBT1386 | 107 | 76 | B | Ac-FQSGGNVFVDGYFERLCAKL-NH2 | 246 |
| JBT1387 | 92 | | C | Ac-FQSEKNVFVDGYFERLCAKL-NH2 | 394 |
| JBT1388 | 90 | | C | Ac-FQSKKNVFVDGYFERLCFKL-NH2 | 395 |
| JBT1389 | 106 | 23 | A | Ac-FQSKRNVFVDGYFERLCAKL-NH2 | 158 |
| JBT1390 | 96 | | A | Ac-FQSPKNVFVDGYFERLCAKL-NH2 | 159 |
| JBT1391 | 99 | | A | Ac-FQSGKNVFVDGYFERLCAKL-NH2 | 160 |
| JBT1392 | 68 | 235 | C | Ac-FQSKQNVFVDGYFERLSAKL-NH2 | 396 |
| JBT1393 | 67 | 205 | C | Ac-FQSKKNVFVDGYFERLSAKL-NH2 | 397 |
| JBT1394 | 88 | 191 | C | Ac-FQSKDNVFVDGYFERLSAKL-NH2 | 398 |
| JBT1395 | 100 | 173 | C | Ac-FQSKHNVFVDGYFERLSAKL-NH2 | 399 |
| JBT1396 | | 29 | A | Ac-FQSK-Nmg-NVFVAGYFERLRAKL-NH2 | 161 |
| JBT1397 | 5 | 1569 | E | Ac-F-Aib-SKGNVFVDGYFERL-Aib-AKL-NH2 | 710 |
| JBT1398 | 5 | 660 | D | Ac-FQ-Aib-KGNVFVDGYFERL-Aib-AKL-NH2 | 665 |
| JBT1399 | 109 | 40 | A | Ac-FQS-Aib-GNVFVDGYFERL-Aib-AKL-NH2 | 162 |
| JBT1400 | 92 | 46 | A | Ac-FQSK-Aib-NVFVDGYFERL-Aib-AKL-NH2 | 163 |

FIG. 32AI

| Object ID | % Inhibition (relative to JBT-0477) | IC50 Mean (nM) | Affinity Class | Sequence | SEQ ID NO: |
|---|---|---|---|---|---|
| JBT1401 | -7 | 913 | D | Ac-FQSKG-Aib-VFVDGYFERL-Aib-AKL-NH2 | 666 |
| JBT1402 | -8 | 1144 | E | Ac-FQSKGN-Aib-FVDGYFERL-Aib-AKL-NH2 | 711 |
| JBT1403 | -6 | >5000 | | Ac-FQSKGNV-Aib-VDGYFERL-Aib-AKL-NH2 | 956 |
| JBT1404 | 13 | 329 | D | Ac-FQSKGNVF-Aib-DGYFERL-Aib-AKL-NH2 | 667 |
| JBT1405 | 6 | 313 | D | Ac-FQSKGNVFV-Aib-GYFERL-Aib-AKL-NH2 | 668 |
| JBT1406 | 3 | 610 | D | Ac-FQSKGNVFVD-Aib-YFERL-Aib-AKL-NH2 | 669 |
| JBT1407 | 6 | >5000 | | Ac-FQSKGNVFVDG-Aib--Aib-AKL-NH2 | 957 |
| JBT1408 | 78 | 92 | B | Ac-FQSKGNVFVDGY-Aib-ERL-Aib-AKL-NH2 | 247 |
| JBT1409 | 104 | 65 | B | Ac-FQSKGNVFVDGYF-Aib-RL-Aib-AKL-NH2 | 248 |
| JBT1410 | -3 | >5000 | | Ac-FQSKGNVFVDGYFE-Aib-L-Aib-AKL-NH2 | 958 |
| JBT1413 | -1 | >5000 | | Ac-FQSKGNVFVDGYFERL-Aib-A-Aib-L-NH2 | 959 |
| JBT1414 | 86 | 119 | C | Ac-FQSKGNVFVDGYFERL-Aib-AK-Aib-NH2 | 400 |
| JBT1415 | 5 | 3668 | F | Ac-Aib-QSKGNVFVDGYFERL-Aib-AKL-NH2 | 741 |
| JBT1584 | | 9 | A | Ac-FQSK-Nmg-NVFVDGYFERL-Aib-AKL-NH2 | 164 |
| JBT1585 | | 12 | A | Ac-FQSK-Nmg-NVFVTGYFERL-Aib-AKL-NH2 | 165 |
| JBT1586 | | 25 | A | AO-FQSKGNVFVDGYFERL-Aib-AKL-NH2 | 166 |
| JBT1587 | | 45 | A | Ac-FQSKGNVFV[CGYFERL-Aib-AKLC-NH2 | 167 |
| JBT1590 | | 106 | C | Ac-FQSKGNVFV[CGYFERL-Aib-AKLC]-NH2 | 401 |
| JBT1591 | | 40 | A | Ac-FQSKGNVFVDGYF[CRL-Aib-AKLC]-NH2 | 168 |
| JBT1592 | | 105 | C | Ac-[CFQSKGNVFVDGYFERLC]AKL-NH2 | 402 |
| JBT1593 | | 462 | D | Ac-FQSKI[CNVFVDGYFERLC]AKL-NH2 | 670 |
| JBT1594 | | 952 | D | Ac-FQSKGNVFV[CGYFERLC]AKL-NH2 | 671 |
| JBT1595 | | 249 | C | Ac-[CFQSKGNVFVC]GYFERL-Aib-AKL-NH2 | 403 |
| JBT1596 | | 129 | C | Ac-[CFQSKGC]VFVEGYFERL-Aib-AKL-NH2 | 404 |
| JBT1597 | | >5000 | | Ac-DGYFERLRAKL-NH2 | 960 |
| JBT1598 | | >5000 | | Ac-FQSKKNV-NH2 | 961 |
| JBT1843 | | 35 | A | Ac-FQSKGNIFVDGYFERLHAKL-NH2 | 169 |

FIG. 32AJ

| Object ID | % Inhibition (relative to JBT-0477) | IC50 Mean (nM) | Affinity Class | Sequence | SEQ ID NO: |
|---|---|---|---|---|---|
| JBT1844 | | 41 | A | Ac-FQSKNNVFVDGYFKRLRAKL-NH2 | 170 |
| JBT1845 | | 89 | B | Ac-FQSYKHVFVDGYFERLRAKL-NH2 | 249 |
| JBT1846 | | 54 | B | Ac-FQSKGIVFVDGYFKRLRAKL-NH2 | 250 |
| JBT1847 | | 30 | A | Ac-YQTKGNVFVDGYFERLRAKL-NH2 | 171 |
| JBT1848 | | 112 | C | Ac-FQSKYNVFVDGYFERLFAKL-NH2 | 405 |
| JBT1849 | | 44 | A | Ac-FQTKDNVHVDGYFERLRAKL-NH2 | 172 |
| JBT1850 | | 56 | B | Ac-FQSYKRVFVDGYFERLRAKL-NH2 | 251 |
| JBT1851 | | 49 | A | Ac-LQQKGNVFVDGYFERLRAKL-NH2 | 173 |
| JBT1852 | | 19 | A | PEG-FQSKGNVFVDGYFERL-Aib-AKL-NH2 | 174 |
| JBT1853 | | 42 | A | PEG-FQSKGNVFVDGYFERL-Aib-AKL-NH2 | 175 |
| JBT1854 | | 16 | A | Ac-FQSKGNVFVDGYFERL-Aib-AKLC(PEG)-NH2 | 176 |
| JBT1855 | | 96 | B | Ac-FQSKGNVFVDGYFERL-Aib-AKLC(PEG)-NH2 | 252 |
| JBT1856 | | 17 | A | Ac-FQSKpNVFVDGYFERL-Aib-AKL-NH2 | 177 |
| JBT1857 | | 14 | A | Ac-FQSKpNVHVDGYFERL-Aib-AKL-NH2 | 178 |
| JBT2266 | | 20 | A | Ac-PFQSKGNVFVDGYFERLRAKL-NH2 | 179 |
| JBT2267 | | 19 | A | Ac-PEFQSKGNVFVDGYFERLRAKL-NH2 | 180 |
| JBT2268 | | 18 | A | Ac-PF-QSK-Nme-NVFVDGYFERL-Aib-AKL-NH2 | 181 |

FIGURE 33

| Object ID | EC50 (nM) | Sequence | SEQ ID NO: |
|---|---|---|---|
| JBT0051 | 1.0 | Biotinyl-Ttds-SGVGRLQVAFQSKKNVFVFGYFERLRAKLTS-NH2 | 962 |
| JBT0055 | 1.7 | Ac-SGVGRLQVAFQSKKNVFVFGYFERLRAKLTS-Ttds-Lysin(biotin)-NH2 | 963 |
| JBT0131 | 16.8 | Biotinyl-Ttds-AFQSKKNVFVFGYFERLRAK-NH2 | 964 |
| JBT0132 | 2.2 | Biotinyl-Ttds-FQSKKNVFVFGYFERLRAKL-NH2 | 965 |
| JBT0133 | >25000 | Biotinyl-Ttds-Ttds-QSKKNVFVFGYFERLRAKLT-NH2 | 966 |
| JBT0134 | >1000 | Biotinyl-Ttds-QSKKNVFVFGYFERLRAK-NH2 | 967 |
| JBT0166 | 0.9 | Biotinyl-Ttds-KKFQSKKNVFVFGYFERLRAKLKK-NH2 | 968 |
| JBT0167* | 574.8 | Biotinyl-Ttds-GKNAKFYLFESLRQVKFVFR-NH2 | 969 |
| JBT0168* | 152.3 | Biotinyl-Ttds-YKFSFNKELFKQARLRFVGV-NH2 | 970 |
| JBT0173 | >5000 | Biotinyl-Ttds-SGVGRLQVAFQSKKNVFVFG-NH2 | 971 |
| JBT0403 | 1.4 | Biotinyl-Ttds-FQSKKNVFVDGYFERLRAKL-NH2 | 972 |

| Object ID | IC50 [nm] | Affinity Class | Sequence | SEQ ID NO: |
|---|---|---|---|---|
| JBT0120 | 59 | B | Ac-SGASRYKWF[CGMRDMKGTMSC]VWVKFRYDTS-NH2 | 1047 |
| JBT0247 | >206 | | Ac-SGASRYKWFCGMRDMKGTMSCVWVKFRYDTS-NH2 | 1213 |
| JBT0248 | 30 | A | Ac-KKSGASRYKWF[CGMRDMKGTMSC]VWVKFRYDTSKK-NH2 | 1001 |
| JBT0249 | >50000 | | Ac-KKSGASRYKWFCGMRDMKGTMSKK-NH2 | 1214 |
| JBT0250 | 8766 | F | Ac-KKSRYKWFCGMRDMKGTMSCVWKK-NH2 | 1201 |
| JBT0251 | 5207 | F | Ac-KKKWFCGMRDMKGTMSCVWVKFKK-NH2 | 1202 |
| JBT0252 | >50000 | | Ac-KKCGMRDMKGTMSCVWVKFRYDKK-NH2 | 1215 |
| JBT0253 | >207 | | Ac-KKMRDMKGTMSCVWVKFRYDTSKK-NH2 | 1216 |
| JBT0319 | 32 | A | Ac-SGASRYKWF[CGMRDMKGTMSC]VWVKFRY-NH2 | 1002 |
| JBT0319 | 109 | C | Ac-SGASRYKWF[CGMRDMKGTMSC]VWVKFRY-NH2 | 1075 |
| JBT0320 | 977 | D | Ac-SGASRYKWF[CGMRDMKGTMSC]VWVK-NH2 | 1103 |
| JBT0321 | >50000 | | Ac-SGASRYKWF[CGMRDMKGTMSC]V-NH2 | 1217 |
| JBT0322 | >50000 | | Ac-SGASRYKWFCGMRDMKGTM-NH2 | 1218 |
| JBT0323 | 118 | C | Ac-SRYKWF[CGMRDMKGTMSC]VWVKFRYDTS-NH2 | 1076 |
| JBT0324 | 1931 | E | Ac-KWF[CGMRDMKGTMSC]VWVKFRYDTS-NH2 | 1155 |
| JBT0325 | >50000 | | Ac-[CGMRDMKGTMSC]VWVKFRYDTS-NH2 | 1219 |
| JBT0326 | >10000 | | Ac-RDMKGTMSCVWVKFRYDTS-NH2 | 1220 |
| JBT0326 | >50000 | | Ac-RDMKGTMSCVWVKFRYDTS-NH2 | 1221 |
| JBT0327 | >50000 | | Ac-SGASRYKWFCGMRDMKGTMS-NH2 | 1222 |
| JBT0328 | >50000 | | Ac-SRYKWF[CGMRDMKGTMSC]VW-NH2 | 1223 |
| JBT0329 | 4574 | E | Ac-KWF[CGMRDMKGTMSC]VWVKF-NH2 | 1156 |
| JBT0329 | 9396 | F | Ac-KWF[CGMRDMKGTMSC]VWVKF-NH2 | 1203 |
| JBT0330 | >50000 | | Ac-[CGMRDMKGTMSC]VWVKFRYD-NH2 | 1224 |
| JBT0331 | >10001 | | Ac-MRDMKGTMSCVWVKFRYDTS-NH2 | 1225 |
| JBT0331 | >50000 | | Ac-MRDMKGTMSCVWVKFRYDTS-NH2 | 1226 |
| JBT0332 | 29746 | G | Ac-SRYKWFCGMRDMKGTMSCVW-NH2 | 1206 |
| JBT0333 | 18840 | G | Ac-KWFCGMRDMKGTMSCVWVKF-NH2 | 1207 |
| JBT0334 | >10002 | | Ac-CGMRDMKGTMSCVWVKFRYD-NH2 | 1227 |
| JBT0409 | 6413 | F | Ac-SGASRYKWFSGMRDMKGTMSSVWVKFRYDTS-NH2 | 1204 |

FIG. 34B

| Object ID | IC50 [nm] | Affinity Class | Sequence | SEQ ID NO: |
|---|---|---|---|---|
| JBT0410 | 24801 | G | Ac-SGASRYKWFSG-Nle-RD-Nle-KGT-Nle-SSVWVKFRYDTS-NH2 | 1208 |
| JBT0411 | 685 | D | Ac-SGASRYKWF[CG-Nle-RD-Nle-KGT-Nle-SC]VWVKFRYDTS-NH2 | 1104 |
| JBT0412 | 16103 | G | Ac-KWF[CG-Nle-RD-Nle-KGT-Nle-SC]VWVKF-NH2 | 1209 |
| JBT0413 | >50000 |  | Ac-KWFSGMRDMKGTMSSVWVKF-NH2 | 1228 |
| JBT0414 | 5693 | F | Ac-KWFSG-Nle-RD-Nle-KGT-Nle-SSVWVKF-NH2 | 1205 |
| JBT0415 | 50 | A | Ac-SRYKWF[CGMRDMKGTMSC]VWVKF-NH2 | 1003 |
| JBT0416 | 187 | C | Ac-SRYKWF[CG-Nle-RD-Nle-KGT-Nle-SC]VWVKF-NH2 | 1077 |
| JBT0417 | >50000 |  | Ac-SRYKWFSGMRDMKGTMSSVWVKF-NH2 | 1229 |
| JBT0418 | 43941 | G | Ac-SRYKWF SG-Nle-RD-Nle-KGT-Nle-SS VWVKF-NH2 | 1210 |
| JBT0435* | 31732 | G | Ac-RKRDVSGKM[CWSGFGSKWFRC]ADMMTYYSVT-NH2 | 1211 |
| JBT0436* | 45925 | G | Ac-RWSGKSTYS[CDAMVRRMGMKC]FSFGWTDVYK-NH2 | 1212 |
| JBT0437 | 60 | B | Ac-ARYKWF[CGMRDMKGTMSC]VWVKF-NH2 | 1048 |
| JBT0438 | 194 | C | Ac-SAYKWF[CGMRDMKGTMSC]VWVKF-NH2 | 1078 |
| JBT0439 | 291 | D | Ac-SRAKWF[CGMRDMKGTMSC]VWVKF-NH2 | 1105 |
| JBT0440 | 393 | D | Ac-SRYAWF[CGMRDMKGTMSC]VWVKF-NH2 | 1106 |
| JBT0441 | >5000 |  | Ac-SRYKAF[CGMRDMKGTMSC]VWVKF-NH2 | 1230 |
| JBT0442 | >5000 |  | Ac-SRYKWA[CGMRDMKGTMSC]VWVKF-NH2 | 1231 |
| JBT0443 | 2861 | E | Ac-SRYKWF AGMRDMKGTMSC VWVKF-NH2 | 1157 |
| JBT0444 | 18 | A | Ac-SRYKWF[CAMRDMKGTMSC]VWVKF-NH2 | 1004 |
| JBT0444 | 31 | A | Ac-SRYKWF[CAMRDMKGTMSC]VWVKF-NH2 | 1005 |
| JBT0445 | 760 | D | Ac-SRYKWF[CGARDMKGTMSC]VWVKF-NH2 | 1107 |
| JBT0446 | 152 | C | Ac-SRYKWF[CGMADMKGTMSC]VWVKF-NH2 | 1079 |
| JBT0447 | 3249 | E | Ac-SRYKWF[CGMRAMKGTMSC]VWVKF-NH2 | 1158 |
| JBT0448 | 315 | D | Ac-SRYKWF[CGMRDAKGTMSC]VWVKF-NH2 | 1108 |
| JBT0449 | 104 | C | Ac-SRYKWF[CGMRDMAGTMSC]VWVKF-NH2 | 1080 |
| JBT0450 | 1061 | E | Ac-SRYKWF[CGMRDMKATMSC]VWVKF-NH2 | 1159 |
| JBT0451 | 131 | C | Ac-SRYKWF[CGMRDMKGAMSC]VWVKF-NH2 | 1081 |
| JBT0452 | 313 | D | Ac-SRYKWF[CGMRDMKGTASC]VWVKF-NH2 | 1109 |
| JBT0453 | 343 | D | Ac-SRYKWF[CGMRDMKGTMAC]VWVKF-NH2 | 1110 |
| JBT0454 | 4963 | E | Ac-SRYKWF CGMRDMKGTMSA VWVKF-NH2 | 1160 |
| JBT0455 | 99 | B | Ac-SRYKWF[CGMRDMKGTMSC]AWVKF-NH2 | 1049 |
| JBT0456 | >5000 |  | Ac-SRYKWF[CGMRDMKGTMSC]VAVKF-NH2 | 1232 |

FIG. 34C

| Object ID | IC50 [nm] | Affinity Class | Sequence | SEQ ID NO: |
|---|---|---|---|---|
| JBT0457 | 2896 | E | Ac-SRYKWF[CGMRDMKGTMSC]VWAKF-NH2 | 1161 |
| JBT0458 | 148 | C | Ac-SRYKWF[CGMRDMKGTMSC]VWVAF-NH2 | 1082 |
| JBT0459 | 150 | C | Ac-SRYKWF[CGMRDMKGTMSC]VWVKA-NH2 | 1083 |
| JBT0460 | 88 | B | Ac-RYKWF[CGMRDMKGTMSC]VWVKF-NH2 | 1050 |
| JBT0461 | 503 | D | Ac-YKWF[CGMRDMKGTMSC]VWVKF-NH2 | 1111 |
| JBT0462 | >5000 | | Ac-SRYKWFGM[CRDMKGTMSC]VWVKF-NH2 | 1233 |
| JBT0463 | >5000 | | Ac-SRYKWFGMRD[CMKGTMSC]VWVKF-NH2 | 1234 |
| JBT0464 | >5000 | | Ac-SRYKWFGMRDMK[CGTMSC]VWVKF-NH2 | 1235 |
| JBT0465 | >5000 | | Ac-SRYKWF[CGMRDMKGTC]MSVWVKF-NH2 | 1236 |
| JBT0466 | >5000 | | Ac-SRYKWF[CGMRDMKC]GTMSVWVKF-NH2 | 1237 |
| JBT0467 | >5000 | | Ac-SRYKWF[CGMRDC]MKGTMSVWVKF-NH2 | 1238 |
| JBT0468 | >5000 | | Ac-SRYKWFG[CMRDMKGTMC]SVWVKF-NH2 | 1239 |
| JBT0469 | >5000 | | Ac-SRYKWFGM[CRDMKGTC]MSVWVKF-NH2 | 1240 |
| JBT0470 | 1472 | E | Ac-SRYKWFGMR[CDMKGC]TMSVWVKF-NH2 | 1162 |
| JBT0617 | 489 | D | Ac-SRYKWF[homoC-GMRDMKGTMSC]VWVKF-NH2 | 1112 |
| JBT0618 | 2073 | E | Ac-SRYKWF[CGMRDMKGTMS-homoC]VWVKF-NH2 | 1163 |
| JBT0619 | >5000 | | Ac-SRYKWF[homoC-GMRDMKGTMS-homoC]VWVKF-NH2 | 1241 |
| JBT0620 | >5000 | | Ac-SRYKWF[Dap-GMRDMKGTMS-D]VWVKF-NH2 | 1242 |
| JBT0623 | >5000 | | Ac-SRYKWF[K-GMRDMKGTMS-D]VWVKF-NH2 | 1243 |
| JBT0625 | >5000 | | Ac-SRYKWF[CMRDMKGTMSC]VWVKF-NH2 | 1244 |
| JBT0626 | 1078 | E | Ac-SRYKWF[CGMRDKGTMSC]VWVKF-NH2 | 1164 |
| JBT0627 | 2169 | E | Ac-SRYKWF[CGMRDMGTMSC]VWVKF-NH2 | 1165 |
| JBT0628 | 3611 | E | Ac-SRYKWF[CGMRDMKGMSC]VWVKF-NH2 | 1166 |
| JBT0629 | 4076 | E | Ac-SRYKWF[cGMRDMKGTMSC]VWVKF-NH2 | 1167 |
| JBT0631 | 343 | D | Ac-SRYKWF[CGmRDMKGTMSC]VWVKF-NH2 | 1113 |
| JBT0632 | >5000 | | Ac-SRYKWF[CGMrDMKGTMSC]VWVKF-NH2 | 1245 |
| JBT0633 | 2131 | E | Ac-SRYKWF[CGMRdMKGTMSC]VWVKF-NH2 | 1168 |
| JBT0634 | 61 | B | Ac-SRYKWF[CGMRDmKGTMSC]VWVKF-NH2 | 1051 |
| JBT0635 | 433 | D | Ac-SRYKWF[CGMRDMkGTMSC]VWVKF-NH2 | 1114 |
| JBT0637 | 3590 | E | Ac-SRYKWF[CGMRDMKGmMSC]VWVKF-NH2 | 1169 |
| JBT0638 | >5000 | | Ac-SRYKWF[CGMRDMKGTmSC]VWVKF-NH2 | 1246 |
| JBT0639 | 1220 | E | Ac-SRYKWF[CGMRDMKGTMsC]VWVKF-NH2 | 1170 |

FIG. 34D

| Object ID | IC50 [nm] | Affinity Class | Sequence | SEQ ID NO: |
|---|---|---|---|---|
| JBT0640 | 3470 | E | Ac-SRYKWF[CGMRDMKGTMSc]VWVKF-NH2 | 1171 |
| JBT0641 | >5000 |  | Ac-SRYKWF[CPMRDMKGTMSC]VWVKF-NH2 | 1247 |
| JBT0642 | >5000 |  | Ac-SRYKWF[CGPRDMKGTMSC]VWVKF-NH2 | 1248 |
| JBT0643 | 23 | A | Ac-SRYKWF[CGMPDMKGTMSC]VWVKF-NH2 | 1006 |
| JBT0644 | 2873 | E | Ac-SRYKWF[CGMRPMKGTMSC]VWVKF-NH2 | 1172 |
| JBT0645 | 165 | C | Ac-SRYKWF[CGMRDPKGTMSC]VWVKF-NH2 | 1084 |
| JBT0646 | 3169 | E | Ac-SRYKWF[CGMRDMPGTMSC]VWVKF-NH2 | 1173 |
| JBT0647 | >5000 |  | Ac-SRYKWF[CGMRDMKPTMSC]VWVKF-NH2 | 1249 |
| JBT0648 | 3682 | E | Ac-SRYKWF[CGMRDMKGPMSC]VWVKF-NH2 | 1174 |
| JBT0649 | 2989 | E | Ac-SRYKWF[CGMRDMKGTPSC]VWVKF-NH2 | 1175 |
| JBT0650 | >5000 |  | Ac-SRYKWF[CGMRDMKGTMPC]VWVKF-NH2 | 1250 |
| JBT0790 | 255 | D | H-GSSRYKWF[CGMRDMKGTMSC]VWVKF-OH | 1115 |
| JBT1416 | 39 | A | Ac-DRYKWF[CGMRDMKGTMSC]VWVKF-NH2 | 1007 |
| JBT1417 | 344 | D | Ac-SDYKWF[CGMRDMKGTMSC]VWVKF-NH2 | 1116 |
| JBT1418 | 1469 | E | Ac-SRDKWF[CGMRDMKGTMSC]VWVKF-NH2 | 1176 |
| JBT1419 | 536 | D | Ac-SRYDWF[CGMRDMKGTMSC]VWVKF-NH2 | 1117 |
| JBT1420 | >5000 |  | Ac-SRYKDF[CGMRDMKGTMSC]VWVKF-NH2 | 1251 |
| JBT1421 | >5000 |  | Ac-SRYKWD[CGMRDMKGTMSC]VWVKF-NH2 | 1252 |
| JBT1422 | >5000 |  | Ac-SRYKWF[CDMRDMKGTMSC]VWVKF-NH2 | 1253 |
| JBT1423 | 4671 | E | Ac-SRYKWF[CGDRDMKGTMSC]VWVKF-NH2 | 1177 |
| JBT1424 | >5000 |  | Ac-SRYKWF[CGMDDMKGTMSC]VWVKF-NH2 | 1254 |
| JBT1425 | 101 | C | Ac-SRYKWF[CGMRDDKGTMSC]VWVKF-NH2 | 1085 |
| JBT1426 | 17 | A | Ac-SRYKWF[CGMRDMDGTMSC]VWVKF-NH2 | 1008 |
| JBT1427 | 87 | B | Ac-SRYKWF[CGMRDMKDTMSC]VWVKF-NH2 | 1052 |
| JBT1428 | 478 | D | Ac-SRYKWF[CGMRDMKGDMSC]VWVKF-NH2 | 1118 |
| JBT1429 | 107 | C | Ac-SRYKWF[CGMRDMKGTDSC]VWVKF-NH2 | 1086 |
| JBT1430 | 265 | D | Ac-SRYKWF[CGMRDMKGTMDC]VWVKF-NH2 | 1119 |
| JBT1431 | >5000 |  | Ac-SRYKWF[CGMRDMKGTMSC]DWVKF-NH2 | 1255 |
| JBT1432 | >5000 |  | Ac-SRYKWF[CGMRDMKGTMSC]VDVKF-NH2 | 1256 |
| JBT1433 | >5000 |  | Ac-SRYKWF[CGMRDMKGTMSC]VWDKF-NH2 | 1257 |
| JBT1434 | 515 | D | Ac-SRYKWF[CGMRDMKGTMSC]VWVDF-NH2 | 1120 |
| JBT1435 | 34 | A | Ac-SRYKWF[CGMRDMKGTMSC]VWVKD-NH2 | 1009 |

FIG. 34E

| Object ID | IC50 [nm] | Affinity Class | Sequence | SEQ ID NO: |
|---|---|---|---|---|
| JBT1436 | 54 | B | Ac-FRYKWF[CGMRDMKGTMSC]VWVKF-NH2 | 1053 |
| JBT1437 | 33 | A | Ac-SFYKWF[CGMRDMKGTMSC]VWVKF-NH2 | 1010 |
| JBT1438 | 40 | A | Ac-SRFKWF[CGVRDMKGTMSC]VWVKF-NH2 | 1011 |
| JBT1439 | 572 | D | Ac-SRYFWF[CGMRDMKGTMSC]VWVKF-NH2 | 1121 |
| JBT1440 | >5000 | | Ac-SRYKFF[CGMRDMKGTMSC]VWVKF-NH2 | 1258 |
| JBT1441 | >5000 | | Ac-SRYKWF[CFMRDMKGTMSC]VWVKF-NH2 | 1259 |
| JBT1442 | 2701 | E | Ac-SRYKWF[CGFRDMKGTMSC]VWVKF-NH2 | 1178 |
| JBT1443 | 1218 | E | Ac-SRYKWF[CGMFDMKGTMSC]VWVKF-NH2 | 1179 |
| JBT1444 | >5000 | | Ac-SRYKWF[CGMRFMKGTMSC]VWVKF-NH2 | 1260 |
| JBT1445 | 43 | A | Ac-SRYKWF[CGMRDFKGTMSC]VWVKF-NH2 | 1012 |
| JBT1446 | 69 | B | Ac-SRYKWF[CGMRDMFGTMSC]VWVKF-NH2 | 1054 |
| JBT1447 | 344 | D | Ac-SRYKWF[CGMRDMKFTMSC]VWVKF-NH2 | 1122 |
| JBT1448 | 296 | D | Ac-SRYKWF[CGMRDMKGFMSC]VWVKF-NH2 | 1123 |
| JBT1449 | 23 | A | Ac-SRYKWF[CGMRDMKGTFSC]VWVKF-NH2 | 1013 |
| JBT1450 | 475 | D | Ac-SRYKWF[CGMRDMKGTMFC]VWVKF-NH2 | 1124 |
| JBT1451 | 236 | C | Ac-SRYKWF[CGMRDMKGTMSC]FWVKF-NH2 | 1087 |
| JBT1452 | 546 | D | Ac-SRYKWF[CGMRDMKGTMSC]VFVKF-NH2 | 1125 |
| JBT1453 | >5000 | | Ac-SRYKWF[CGMRDMKGTMSC]VWFKF-NH2 | 1261 |
| JBT1454 | >5000 | | Ac-SRYKWF[CGMRDMKGTMSC]VWVFF-NH2 | 1262 |
| JBT1455 | 39 | A | Ac-GRYKWF[CGMRDMKGTMSC]VWVKF-NH2 | 1014 |
| JBT1456 | 265 | D | Ac-SGYKWF[CGMRGMKGTMSC]VWVKF-NH2 | 1126 |
| JBT1457 | 1866 | E | Ac-SRGKWF[CGMRDMKGTMSC]VWVKF-NH2 | 1180 |
| JBT1458 | 430 | D | Ac-SRYGWF[CGMRDMKGTMSC]VWVKF-NH2 | 1127 |
| JBT1459 | >5000 | | Ac-SRYKGF[CGMRDMKGTMSC]VWVKF-NH2 | 1263 |
| JBT1460 | >5000 | | Ac-SRYKWG[CGGRDMKGTMSC]VWVKF-NH2 | 1264 |
| JBT1461 | 2099 | E | Ac-SRYKWF[CGMGDMKGTMSC]VWVKF-NH2 | 1181 |
| JBT1462 | 370 | D | Ac-SRYKWF[CGMRGMKGTMSC]VWVKF-NH2 | 1128 |
| JBT1463 | 682 | D | Ac-SRYKWF[CGMRDGKGTMSC]VWVKF-NH2 | 1129 |
| JBT1464 | 150 | C | Ac-SRYKWF[CGMRDMGGTMSC]VWVKF-NH2 | 1088 |
| JBT1465 | 50 | A | Ac-SRYKWF[CGMRDMKGGMSC]VWVKF-NH2 | 1015 |
| JBT1466 | 85 | B | Ac-SRYKWF[CGMRDMKGGMSC]VWVKF-NH2 | 1055 |
| JBT1467 | 290 | D | Ac-SRYKWF[CGMRDMKGTGSC]VWVKF-NH2 | 1130 |

FIG. 34F

| Object ID | IC50 [nm] | Affinity Class | Sequence | SEQ ID NO: |
|---|---|---|---|---|
| JBT1468 | 778 | D | Ac-SRYKWF[CGMRDMKGTMGC]VWVKF-NH2 | 1131 |
| JBT1469 | 2366 | E | Ac-SRYKWF[CGMRDMKGTMSC]GWVKF-NH2 | 1182 |
| JBT1470 | >5000 | | Ac-SRYKWF[CGMRDMKGTMSC]VGVKF-NH2 | 1265 |
| JBT1471 | >5000 | | Ac-SRYKWF[CGMRDMKGTMSC]VWGKF-NH2 | 1266 |
| JBT1472 | 158 | C | Ac-SRYKWF[CGMRDMKGTMSC]VWVGF-NH2 | 1089 |
| JBT1473 | 176 | C | Ac-SRYKWF[CGMRDMKGTMSC]VWVKG-NH2 | 1090 |
| JBT1474 | 31 | A | Ac-KRYKWF[CGMRDMKGTMSC]VWVKF-NH2 | 1016 |
| JBT1475 | 69 | B | Ac-SKYKWF[CGMRDMKGTMSC]VWVKF-NH2 | 1056 |
| JBT1476 | 282 | D | Ac-SRKKWF[CGMRDMKGTMSC]VWVKF-NH2 | 1132 |
| JBT1477 | >5000 | | Ac-SRYKKF[CGMRDMKGTMSC]VWVKF-NH2 | 1267 |
| JBT1478 | 162 | C | Ac-SRYKWK[CGMRDMKGTMSC]VWVKF-NH2 | 1091 |
| JBT1479 | 1110 | E | Ac-SRYKWF[CKMRDMKGTMSC]VWVKF-NH2 | 1183 |
| JBT1480 | 392 | D | Ac-SRYKWF[CGKRDMKGTMSC]VWVKF-NH2 | 1133 |
| JBT1481 | 20 | A | Ac-SRYKWF[CGMRKMKGTMSC]VWVKF-NH2 | 1017 |
| JBT1482 | 1354 | E | Ac-SRYKWF[CGMRDKKGTMSC]VWVKF-NH2 | 1184 |
| JBT1483 | 59 | B | Ac-SRYKWF[CGMRDMKKTMSC]VWVKF-NH2 | 1057 |
| JBT1484 | 520 | D | Ac-SRYKWF[CGMRDMKGKMSC]VWVKF-NH2 | 1134 |
| JBT1485 | 67 | B | Ac-SRYKWF[CGMRDMKGTKSC]VWVKF-NH2 | 1058 |
| JBT1486 | 54 | B | Ac-SRYKWF[CGMRDMKGTMKC]VWVKF-NH2 | 1059 |
| JBT1487 | 434 | D | Ac-SRYKWF[CGMRDMKGTMSK]VWVKF-NH2 | 1135 |
| JBT1488 | >5000 | | Ac-SRYKWF[CGMRDMKGTMSC]KWVKF-NH2 | 1268 |
| JBT1489 | >5000 | | Ac-SRYKWF[CGMRDMKGTMSC]VKVKF-NH2 | 1269 |
| JBT1490 | >5000 | | Ac-SRYKWF[CGMRDMKGTMSC]VWKKF-NH2 | 1270 |
| JBT1491 | 335 | D | Ac-SRYKWF[CGMRDMKGTMSC]VWVKK-NH2 | 1136 |
| JBT1492 | 38 | A | Ac-LRYKWF[CGMRDMKGTMSC]VWVKF-NH2 | 1018 |
| JBT1493 | 51 | B | Ac-SLYKWF[CGMRDMKGTMSC]VWVKF-NH2 | 1060 |
| JBT1494 | 679 | D | Ac-SRLKWF[CGMRDMKGTMSC]VWVKF-NH2 | 1137 |
| JBT1495 | 729 | D | Ac-SRYLWF[CGMRDMKGTMSC]VWVKF-NH2 | 1138 |
| JBT1496 | >5000 | | Ac-SRYKLF[CGMRDMKGTMSC]VWVKF-NH2 | 1271 |
| JBT1497 | 72 | B | Ac-SRYKWL[CGMRDMKGTMSC]VWVKF-NH2 | 1061 |
| JBT1498 | >5000 | | Ac-SRYKWF[CLMRDMKGTMSC]VWVKF-NH2 | 1272 |
| JBT1499 | 636 | D | Ac-SRYKWF[CGLRDMKGTMSC]VWVKF-NH2 | 1139 |

FIG. 34G

| Object ID | IC50 [nm] | Affinity Class | Sequence | SEQ ID NO: |
|---|---|---|---|---|
| JBT1500 | 68 | B | Ac-SRYKWF[CGMLDMKGTMSC]VWVKF-NH2 | 1062 |
| JBT1501 | 3449 | E | Ac-SRYKWF[CGMRLMKGTMSC]VWVKF-NH2 | 1185 |
| JBT1502 | 38 | A | Ac-SRYKWF[CGMRDLKGTMSC]VWVKF-NH2 | 1019 |
| JBT1503 | 54 | B | Ac-SRYKWF[CGMRDMLGTMSC]VWVKF-NH2 | 1063 |
| JBT1504 | 757 | D | Ac-SRYKWF[CGMRDMKLTMSC]VWVKF-NH2 | 1140 |
| JBT1505 | 155 | C | Ac-SRYKWF[CGMRDMKGLMSC]VWVKF-NH2 | 1092 |
| JBT1506 | 57 | B | Ac-SRYKWF[CGMRDMKGTLSC]VWVKF-NH2 | 1064 |
| JBT1507 | 411 | D | Ac-SRYKWF[CGMRDMKGTMLC]VWVKF-NH2 | 1014 |
| JBT1508 | 216 | C | Ac-SRYKWF[CGMRDMKGTMSC]LWVKF-NH2 | 1093 |
| JBT1509 | >5000 |  | Ac-SRYKWF[CGMRDMKGTMSC]VLVKF-NH2 | 1273 |
| JBT1510 | 221 | C | Ac-SRYKWF[CGMRDMKGTMSC]VWLKF-NH2 | 1094 |
| JBT1511 | 330 | D | Ac-SRYKWF[CGMRDMKGTMSC]VWVLF-NH2 | 1142 |
| JBT1512 | 18 | A | Ac-SSYKWF[CGMRDMKGTMSC]VWVKL-NH2 | 1020 |
| JBT1513 | 56 | B | Ac-SSYKWF[CGMRDMKGTMSC]VWVKF-NH2 | 1065 |
| JBT1514 | 92 | B | Ac-SRSKWF[CGMRDMKGTMSC]VWVKF-NH2 | 1066 |
| JBT1515 | 411 | D | Ac-SRYSWF[CGMRDMKGTMSC]VWVKF-NH2 | 1143 |
| JBT1516 | >5000 |  | Ac-SRYKSF[CGMRDMKGTMSC]VWVKF-NH2 | 1274 |
| JBT1517 | >5000 |  | Ac-SRYKWS[CGMRDMKGTMSC]VWVKF-NH2 | 1275 |
| JBT1518 | 50 | A | Ac-SRYKWF[CSMRDMKGTMSC]VWVKF-NH2 | 1021 |
| JBT1519 | 1825 | E | Ac-SRYKWF[CGSRDMKGTMSC]VWVKF-NH2 | 1186 |
| JBT1520 | 202 | C | Ac-SRYKWF[CGMSDMKGTMSC]VWVKF-NH2 | 1095 |
| JBT1521 | 226 | C | Ac-SRYKWF[CGMRSMKGTMSC]VWVKF-NH2 | 1096 |
| JBT1522 | 92 | B | Ac-SRYKWF[CGMRDSKGTMSC]VWVKF-NH2 | 1067 |
| JBT1523 | 35 | A | Ac-SRYKWF[CGMRDMSGTMSC]VWVKF-NH2 | 1022 |
| JBT1524 | 512 | D | Ac-SRYKWF[CGMRDMKSTMSC]VWVKF-NH2 | 1144 |
| JBT1525 | 56 | B | Ac-SRYKWF[CGMRDMKGSMSC]VWVKF-NH2 | 1068 |
| JBT1526 | 80 | B | Ac-SRYKWF[CGMRDMKGTSSC]VWVKF-NH2 | 1069 |
| JBT1527 | 190 | C | Ac-SRYKWF[CGMRDMKGTMSC]SWVKF-NH2 | 1097 |
| JBT1528 | >5000 |  | Ac-SRYKWF[CGMRDMKGTMSC]VSVKF-NH2 | 1276 |
| JBT1529 | >5000 |  | Ac-SRYKWF[CGMRDMKGTMSC]VWSKF-NH2 | 1277 |
| JBT1530 | 83 | B | Ac-SRYKWF[CGMRDMKGTMSC]VWVSF-NH2 | 1070 |
| JBT1531 | 63 | B | Ac-SRYKWF[CGMRDMKGTMSC]VWVKS-NH2 | 1071 |

FIG. 34H

| Object ID | IC50 [nm] | Affinity Class | Sequence | SEQ ID NO: |
|---|---|---|---|---|
| JBT1532 | 54 | B | Ac-PRYKWF[CGMRDMKGTMSC]VWVKF-NH2 | 1072 |
| JBT1533 | 263 | D | Ac-SPYKWF[CGMRDMKGTMSC]VWVKF-NH2 | 1145 |
| JBT1534 | 2398 | E | Ac-SRPKWF[CGMRDMKGTMSC]VWVKF-NH2 | 1187 |
| JBT1535 | >5000 | | Ac-SRYPWF[CGMRDMKGTMSC]VWVKF-NH2 | 1278 |
| JBT1536 | >5000 | | Ac-SRYKPF[CGMRDMKGTMSC]VWVKF-NH2 | 1279 |
| JBT1537 | >5000 | | Ac-SRYKWP[CGMRDMKGTMSC]VWVKF-NH2 | 1280 |
| JBT1538 | >5000 | | Ac-SRYKWF[CGMRDMKGTMSC]PWVKF-NH2 | 1281 |
| JBT1539 | >5000 | | Ac-SRYKWF[CGMRDMKGTMSC]VPVKF-NH2 | 1282 |
| JBT1540 | >5000 | | Ac-SRYKWF[CGMRDMKGTMSC]VWPKF-NH2 | 1283 |
| JBT1541 | 29 | A | Ac-SRYKWF[CGMRDMKGTMSC]VWVPF-NH2 | 1023 |
| JBT1542 | 1052 | E | Ac-SRYKWF[CGMRDMKGTMSC]VWVKP-NH2 | 1188 |
| JBT1543 | 202 | C | Ac-SRYKWF[CGMRDMKGTMSC]VWVKF-OH | 1098 |
| JBT1544 | 40 | A | H-SRYKWF[CGMRDMKGTMSC]VWVKF-NH2 | 1024 |
| JBT1545 | 239 | C | H-SRYKWF[CGMRDMKGTMSC]VWVKF-OH | 1099 |
| JBT1546 | >5000 | | Ac-SRYKWF[CEMRDMKGTMSC]VWVKF-NH2 | 1284 |
| JBT1547 | >5000 | | Ac-SRYKWF[CHMRDMKGTMSC]VWVKF-NH2 | 1285 |
| JBT1548 | >5000 | | Ac-SRYKWF[CIMRDMKGTMSC]VWVKF-NH2 | 1286 |
| JBT1549 | 1736 | E | Ac-SRYKWF[CMMRDMKGTMSC]VWVKF-NH2 | 1189 |
| JBT1550 | 1086 | E | Ac-SRYKWF[CNMRDMKGTMSC]VWVKF-NH2 | 1190 |
| JBT1551 | 682 | D | Ac-SRYKWF[CQMRDMKGTMSC]VWVKF-NH2 | 1146 |
| JBT1552 | 400 | D | Ac-SRYKWF[CRMRDMKGTMSC]VWVKF-NH2 | 1147 |
| JBT1553 | 292 | D | Ac-SRYKWF[CTMRDMKGTMSC]VWVKF-NH2 | 1148 |
| JBT1554 | >5000 | | Ac-SRYKWF[CVMRDMKGTMSC]VWVKF-NH2 | 1287 |
| JBT1555 | 3382 | E | Ac-SRYKWF[CWMRDMKGTMSC]VWVKF-NH2 | 1191 |
| JBT1556 | >5000 | | Ac-SRYKWF[CYMRDMKGTMSC]VWVKF-NH2 | 1288 |
| JBT1557 | 60 | B | H-RYKWF[CGMRDMKGTMSC]VWVKF-NH2 | 173 |
| JBT1558 | 975 | D | H-YKWF[CGMRDMKGTMSC]VWVKF-NH2 | 1149 |
| JBT1559 | 286 | D | Ac-SRYKWF[CGaRDMKGTMSC]VWVKF-NH2 | 1150 |
| JBT1560 | >5000 | | Ac-SRYKWF[CGdRDMKGTMSC]VWVKF-NH2 | 1289 |
| JBT1561 | 3031 | E | Ac-SRYKWF[CGiRDMKGTMSC]VWVKF-NH2 | 1192 |
| JBT1562 | 1783 | E | Ac-SRYKWF[CGkRDMKGTMSC]VWVKF-NH2 | 1193 |
| JBT1563 | 1821 | E | Ac-SRYKWF[CGlRDMKGTMSC]VWVKF-NH2 | 1194 |

FIG. 34I

| Object ID | IC50 [nm] | Affinity Class | Sequence | SEQ ID NO: |
|---|---|---|---|---|
| JBT1564 | 170 | C | Ac-SRYKWF[CGpRDMKGTMSC]VWVKF-NH2 | 1100 |
| JBT1565 | 1712 | E | Ac-SRYKWF[CGsRDMKGTMSC]VWVKF-NH2 | 1195 |
| JBT1566 | 367 | D | Ac-SRYKWF[CGMRDaKGTMSC]VWVKF-NH2 | 1151 |
| JBT1567 | 212 | C | Ac-SRYKWF[CGMRDdKGTMSC]VWVKF-NH2 | 1101 |
| JBT1568 | 73 | B | Ac-SRYKWF[CGMRDfKGTMSC]VWVKF-NH2 | 1074 |
| JBT1569 | 155 | C | Ac-SRYKWF[CGMRDkKGTMSC]VWVKF-NH2 | 1102 |
| JBT1570 | 47 | A | Ac-SRYKWF[CGMRDIKGTMSC]VWVKF-NH2 | 1025 |
| JBT1571 | 1320 | E | Ac-SRYKWF[CGMRDpKGTMSC]VWVKF-NH2 | 1196 |
| JBT1572 | 650 | D | Ac-SRYKWF[CGMRDsKGTMSC]VWVKF-NH2 | 1152 |
| JBT1573 | 1154 | E | Ac-SRYKWF[CGMRDMaGTMSC]VWVKF-NH2 | 1197 |
| JBT1574 | 350 | D | Ac-SRYKWF[CGMRDMdGTMSC]VWVKF-NH2 | 1153 |
| JBT1575 | 2377 | E | Ac-SRYKWF[CGMRDMfGTMSC]VWVKF-NH2 | 1198 |
| JBT1576 | 1004 | E | Ac-SRYKWF[CGMRDMlGTMSC]VWVKF-NH2 | 1199 |
| JBT1577 | 1121 | E | Ac-SRYKWF[CGMRDMpGTMSC]VWVKF-NH2 | 1200 |
| JBT1578 | 633 | D | Ac-SRYKWF[CGMRDMsGTMSC]VWVKF-NH2 | 1154 |
| JBT1735 | 9 | A | Ac-SMYKWH[CGMRDMKGTYSC]VWVKF-NH2 | 1026 |
| JBT1772 | 11 | A | Ac-FHYKWH[CGMRDMKGTYSC]VWVKF-NH2 | 1027 |
| JBT1808 | 12 | A | Ac-SYYKWH[CGMRDMKGIMSC]AWVKF-NH2 | 1028 |
| JBT1811 | 11 | A | Ac-SYYKWH[CGMRDMKGIMSC]VWVKY-NH2 | 1029 |
| JBT1812 | 11 | A | Ac-SYYKWH[CGMRDMKGIDSC]VWVRF-NH2 | 1030 |
| JBT1813 | 9 | A | Ac-SYYKWH[CGMRDMKGIMSC]VWVKA-NH2 | 1031 |
| JBT1815 | 10 | A | Ac-SYYKWH[CGMRDMKGTMTC]VWVKF-NH2 | 1032 |
| JBT1816 | 9 | A | Ac-SYYKWH[CGMRDMKGTMSC]VWVKS-NH2 | 1033 |
| JBT1817 | 9 | A | Ac-SHYKWH[CAMRDMKGTYSC]VWVKF-NH2 | 1034 |
| JBT1821 | 11 | A | Ac-SYYKWH[CGVRDMKGTMSC]VWVKS-NH2 | 1035 |
| JBT1822 | 18 | A | Ac-GHYKWH[CGMRDMKGTFSC]VWVF-NH2 | 1036 |
| JBT1825 | 11 | A | Ac-AYYKWH[CGMRDLKGTMSC]VWVKS-NH2 | 1037 |
| JBT1826 | 11 | A | Ac-SHYKWH[CGMRDMKGTYSC]VWVKM-NH2 | 1038 |
| JBT1828 | 22 | A | Ac-SHYKWH[CGMRDMKGIMSC]VWVF-NH2 | 1039 |
| JBT1829 | 8 | A | Ac-FYYKWH[CGMRDMKGTMSC]AWVKF-NH2 | 1040 |
| JBT1830 | 10 | A | Ac-SYYKWH[CGMRDMKGTDSC]VWVWY-NH2 | 1041 |
| JBT1831 | 13 | A | Ac-SHYKWH[CGMRDMKGTMSC]AWVKF-NH2 | 1042 |

FIG. 34J

| Object ID | IC50 [nm] | Affinity Class | Sequence | SEQ ID NO: |
|---|---|---|---|---|
| JBT1832 | 11 | A | Ac-HYYKWH[CGMRDMKGTMSC]VWVKS-NH2 | 1043 |
| JBT1837 | 10 | A | Ac-SYYKWH[CAMRDMKGTMTC]VWVKF-NH2 | 1044 |
| JBT1840 | 11 | A | Ac-SYYKWH[CGMRDMKGTMSC]VWVLF-NH2 | 1045 |
| JBT1842 | 9 | A | Ac-SHYKWH[CAMRDMKGTMSC]AWVKF-NH2 | 1046 |

FIGURE 35

| Object ID | EC50(nM) | Sequence | SEQ ID NO: |
|---|---|---|---|
| JBT0124 | 1.8 | Biotinyl-Ttds-SGASRYKWF[CGMRDMKGTMSC]VWVKFRYDTS-NH2 | 1290 |
| JBT0659 | 2.1 | Biotinyl-Ttds-SRYKWF[CGMRDMKGTMSC]VWVKF-NH2 | 1291 |

FIG. 36A

| Object ID | IC50 [nM] | Affinity Class | Sequence | SEQ ID NO: |
|---|---|---|---|---|
| JBT0122 | 3084 | E | Ac-SGYASFPLAVQLHVSKRSKEMALARLYYKTS-NH2 | 2002 |
| JBT0221 | 1412 | E | Ac-KKSGYASFPLAVQLHVSKRSKEMALARLYYKTSKK-NH2 | 2003 |
| JBT0222* | 36272 | G | Ac-MKSRSLGLAYFAKHSSLEVLQTRKVAAPYY-NH2 | 2127 |
| JBT0223* | >50000 | | Ac-KMQLRVYASTAHSRYLLGSSLFPKYAEVKA-NH2 | 2297 |
| JBT0224 | >50000 | | Ac-KKSGYASFPLAVQLHVSKRSKEMALARLYYKK-NH2 | 2298 |
| JBT0225 | 25395 | G | Ac-KKSGYASFPLAVQLHVSKRSKEMALARKK-NH2 | 2128 |
| JBT0226 | >50000 | | Ac-KKSGYASFPLAVQLHVSKRSKEMAKK-NH2 | 2299 |
| JBT0227 | >50000 | | Ac-KKSGYASFPLAVQLHVSKRSKKK-NH2 | 2300 |
| JBT0228 | 5436 | F | Ac-KKASFPLAVQLHVSKRSKEMALARLYYKTSKK-NH2 | 2016 |
| JBT0229 | 16971 | G | Ac-KKPLAVQLHVSKRSKEMALARLYYKTSKK-NH2 | 2129 |
| JBT0230 | >50000 | | Ac-KKVQLHVSKRSKEMALARLYYKTSKK-NH2 | 2301 |
| JBT0231 | >50000 | | Ac-KKHVSKRSKEMALARLYYKTSKK-NH2 | 2302 |
| JBT0232 | >50000 | | Ac-KKGYASFPLAVQLHVSKRSKEMKK-NH2 | 2303 |
| JBT0233 | >50000 | | Ac-KKYASFPLAVQLHVSKRSKEMAKK-NH2 | 2304 |
| JBT0234 | >50000 | | Ac-KKVQLHVSKRSKEMALARLYYKKK-NH2 | 2305 |
| JBT0235 | >50000 | | Ac-KKQLHVSKRSKEMALARLYYKTKK-NH2 | 2306 |
| JBT0236 | >50000 | | Ac-KKLHVSKRSKEMALARLYYKTSKK-NH2 | 2307 |
| JBT0237 | >50000 | | Ac-KKSGYASFPLAVQLHVSKRSKEKK-NH2 | 2308 |
| JBT0359 | >50000 | | Ac-ASFPLAVQLHVSKRSKEMA-NH2 | 2309 |
| JBT0360 | >50000 | | Ac-SFPLAVQLHVSKRSKEMA-NH2 | 2310 |
| JBT0361 | >50000 | | Ac-FPLAVQLHVSKRSKEMA-NH2 | 2311 |
| JBT0362 | >50000 | | Ac-ASFPLAVQLHVSKRSKEM-NH2 | 2312 |
| JBT0363 | >50000 | | Ac-ASFPLAVQLHVSKRSKE-NH2 | 2313 |
| JBT0364 | >50000 | | Ac-ASFPLAVQLHVSKRSKEMAL-NH2 | 2314 |
| JBT0365 | >50000 | | Ac-ASFPLAVQLHVSKRSKEMALA-NH2 | 2315 |
| JBT0366 | >50000 | | Ac-ASFPLAVQLHVSKRSKEMALAR-NH2 | 2316 |
| JBT0367 | >50000 | | Ac-ASFPLAVQLHVSKRSKEMALARL-NH2 | 2317 |
| JBT0368 | 27346 | G | Ac-ASFPLAVQLHVSKRSKEMALARLY-NH2 | 2130 |
| JBT0369 | 5107 | F | Ac-ASFPLAVQLHVSKRSKEMALARLYY-NH2 | 2017 |
| JBT0370 | >50000 | | Ac-YASFPLAVQLHVSKRSKEMA-NH2 | 2318 |
| JBT0371 | >50000 | | Ac-GYASFPLAVQLHVSKRSKEMA-NH2 | 2319 |
| JBT0660 | 2645 | E | Ac-AGYASFPLAVQLHVSKRSKEMALARLYYKTS-NH2 | 2004 |

FIG. 36B

| Object ID | IC50 [nM] | Affinity Class | Sequence | SEQ ID NO: |
|---|---|---|---|---|
| JBT0661 | 1383 | E | Ac-SAYASFPLAVQLHVSKRSKEMALARLYYKTS-NH2 | 2005 |
| JBT0662 | 13759 | G | Ac-SGAASFPLAVQLHVSKRSKEMALARLYYKTS-NH2 | 2131 |
| JBT0664 | 2739 | E | Ac-SGYAAFPLAVQLHVSKRSKEMALARLYYKTS-NH2 | 2006 |
| JBT0665 | 25704 | G | Ac-SGYASAPLAVQLHVSKRSKEMALARLYYKTS-NH2 | 2132 |
| JBT0666 | 915 | D | Ac-SGYASFALAVQLHVSKRSKEMALARLYYKTS-NH2 | 2001 |
| JBT0667 | 9314 | F | Ac-SGYASFPAAVQLHVSKRSKEMALARLYYKTS-NH2 | 2018 |
| JBT0669 | 33021 | G | Ac-SGYASFPLAAQLHVSKRSKEMALARLYYKTS-NH2 | 2133 |
| JBT0670 | 2506 | E | Ac-SGYASFPLAVALHVSKRSKEMALARLYYKTS-NH2 | 2007 |
| JBT0671 | 5836 | F | Ac-SGYASFPLAVQAHVSKRSKEMALARLYYKTS-NH2 | 2019 |
| JBT0672 | 38327 | G | Ac-SGYASFPLAVQLAVSKRSKEMALARLYYKTS-NH2 | 2134 |
| JBT0673 | 16425 | G | Ac-SGYASFPLAVQLHASKRSKEMALARLYYKTS-NH2 | 2135 |
| JBT0674 | 1173 | E | Ac-SGYASFPLAVQLHVAKRSKEMALARLYYKTS-NH2 | 2008 |
| JBT0675 | 18317 | G | Ac-SGYASFPLAVQLHVSARSKEMALARLYYKTS-NH2 | 2136 |
| JBT0676 | 37412 | G | Ac-SGYASFPLAVQLHVSKASKEMALARLYYKTS-NH2 | 2137 |
| JBT0677 | 1905 | E | Ac-SGYASFPLAVQLHVSKRAKEMALARLYYKTS-NH2 | 2009 |
| JBT0678 | 4071 | E | Ac-SGYASFPLAVQLHVSKRSAEMALARLYYKTS-NH2 | 2010 |
| JBT0679 | 6196 | F | Ac-SGYASFPLAVQLHVSKRSKAMALARLYYKTS-NH2 | 2020 |
| JBT0680 | 20935 | G | Ac-SGYASFPLAVQLHVSKRSKEAALARLYYKTS-NH2 | 2138 |
| JBT0682 | 10271 | G | Ac-SGYASFPLAVQLHVSKRSKEMAAARLYYKTS-NH2 | 2139 |
| JBT0684 | 4567 | E | Ac-SGYASFPLAVQLHVSKRSKEMALAALYYKTS-NH2 | 2011 |
| JBT0685 | 9134 | F | Ac-SGYASFPLAVQLHVSKRSKEMALARAYYKTS-NH2 | 2021 |
| JBT0686 | 13474 | G | Ac-SGYASFPLAVQLHVSKRSKEMALARLAYKTS-NH2 | 2140 |
| JBT0687 | 11783 | G | Ac-SGYASFPLAVQLHVSKRSKEMALARLYAKTS-NH2 | 2141 |
| JBT0688 | 4196 | E | Ac-SGYASFPLAVQLHVSKRSKEMALARLYYATS-NH2 | 2012 |
| JBT0689 | 3127 | E | Ac-SGYASFPLAVQLHVSKRSKEMALARLYYKAS-NH2 | 2013 |
| JBT0690 | 3000 | E | Ac-SGYASFPLAVQLHVSKRSKEMALARLYYKTA-NH2 | 2014 |
| JBT0788 | 16205 | G | H-GSSGYASFPLAVQLHVSKRSKEMALARLYYKTS-OH | 2142 |
| JBT1579 | 2593 | E | Ac-GYASFPLAVQLIIVAKRSKEMA-NH2 | 2015 |
| JBT1580 | >50000 | | Ac-GYASFALSVQLHVSKRSKEMA-NH2 | 2320 |
| JBT1581 | >50000 | | Ac-GYASFALAVQLHVAKRSKEMA-NH2 | 2321 |
| JBT1582 | 5841 | F | Ac-GYASFPLAVQLHVMKRSKEMA-NH2 | 2022 |
| JBT1583 | >50000 | | Ac-GYASFALAVQLHVMKRSKEMA-NH2 | 2322 |

FIG. 36C

| Object ID | IC50 [nM] | Affinity Class | Sequence | SEQ ID NO: |
|---|---|---|---|---|
| JBT1599 | >50000 | | Ac-FPLAVQLHVSKRSKEMALA-NH2 | 2323 |
| JBT1600 | >50000 | | Ac-QLHVSKRSKEMALA-NH2 | 2324 |
| JBT1601 | >50000 | | Ac-SGYASFP-NH2 | 2325 |
| JBT1602 | >50000 | | Ac-LAVQLHVSKRSKEMALARL-NH2 | 2326 |
| JBT1644 | | | Ac-VYASFFLTVQLHVSKRSKEMA-NH2 | 2327 |
| JBT1645 | | | Ac-GYWSFPQAVQLHVSKRSKEMA-NH2 | 2328 |
| JBT1646 | | | Ac-GYASFILAVQLHVSKRSKEMA-NH2 | 2329 |
| JBT1647 | | | Ac-GYWSFYLAVQLHVSKRSKEMA-NH2 | 2330 |
| JBT1648 | | | Ac-SYASFFLAVQLHVSKRSFEMA-NH2 | 2331 |
| JBT1649 | 10282 | G | Ac-GYWSFPHAVWHHVSKRSKEMA-NH2 | 2143 |
| JBT1650 | | | Ac-GYASFILAVQLHIIKRSKEMA-NH2 | 2332 |
| JBT1651 | | | Ac-GMASFFLARDLHWSKVFKEMA-NH2 | 2333 |
| JBT1653 | | | Ac-EYAQFWLAVQLHVSKRSKEMA-NH2 | 2334 |
| JBT1654 | | | Ac-GYASFPLIVQLHVSKRSKEMA-NH2 | 2335 |
| JBT1655 | | | Ac-GYASFPIHVQHHVSKRSKEMA-NH2 | 2336 |
| JBT1656 | | | Ac-GYASFALMVQLHVSKRSKEMA-NH2 | 2337 |
| JBT1657 | | | Ac-GYASFHQAVQRHVSKRSKEMA-NH2 | 2338 |
| JBT1658 | | | Ac-GYASFALMVQHHVSKRSKEMA-NH2 | 2339 |
| JBT1659 | 14473 | G | Ac-GYASFWQAVQLHVWKRSKEIA-NH2 | 2144 |
| JBT1660 | 14063 | G | Ac-GYASFPLIVWLHVSKRSKEMA-NH2 | 2145 |
| JBT1661 | | | Ac-GYASFSLAVQLHVSKRSKEMA-NH2 | 2340 |
| JBT1662 | | | Ac-GYHSFKLAVQLHVSKRSKEIA-NH2 | 2341 |
| JBT1663 | 12912 | G | Ac-GYASFWQAVQLHVSKRSKEIA-NH2 | 2146 |
| JBT1664 | | | Ac-GYASYVLAVQHHVSWRSWEMA-NH2 | 2342 |
| JBT1665 | | | Ac-HYHSLPKQVQLHVSKRSKEMA-NH2 | 2343 |
| JBT1666 | | | Ac-GYASFSLAVQLHVHKRSYEMA-NH2 | 2344 |
| JBT1668 | | | Ac-GYASFELLVQLHVSKRSKEMA-NH2 | 2345 |
| JBT1669 | | | Ac-SYSSFKLAVQLHVSKRSKEMA-NH2 | 2346 |
| JBT1670 | | | Ac-GYAWFPLNVWLHVHKRSHEMA-NH2 | 2347 |
| JBT1671 | | | Ac-GYASFWLSVQTHVSKRSKEMA-NH2 | 2348 |

FIG. 36D

| Object ID | IC50 [nM] | Affinity Class | Sequence | SEQ ID NO: |
|---|---|---|---|---|
| JBT1672 | | | Ac-GYASFPLMVQLHVIKRSKEMA-NH2 | 2349 |
| JBT1673 | | | Ac-GYWSFNLVVQLHVSKRSKRSKEMA-NH2 | 2350 |
| JBT1674 | | | Ac-GYASFHLAVQLHVWKRSKRSKEMA-NH2 | 2351 |
| JBT1675 | | | Ac-GYASFWLVVQLHVVQLHVSKRSKEMA-NH2 | 2352 |
| JBT1676 | | | Ac-GYWSFPLAVQLHVWKRSWEMA-NH2 | 2353 |
| JBT1677 | | | Ac-GYASFPWYVQLHVSKRSKEMA-NH2 | 2354 |
| JBT1678 | | | Ac-GYTSFQLAVQLHVSKRSKEMA-NH2 | 2355 |
| JBT1679 | | | Ac-RYASFPLAVYLHVTKRSKEMA-NH2 | 2356 |
| JBT1680 | | | Ac-GYWSFPLAVQLHVSKRLKEMA-NH2 | 2357 |
| JBT1681 | | | Ac-GHASFQTAVQQHVSKRSKEMA-NH2 | 2358 |
| JBT1682 | | | Ac-FHVSKRSKEMA-NH2 | 2359 |
| JBT1683 | | | Ac-GYASFWHAVQLHVSKRSKEMA-NH2 | 2360 |
| JBT1684 | | | Ac-GIASFILAVQLHVYKRSKEMA-NH2 | 2361 |
| JBT1685 | | | Ac-GYTSFMQAVQHHVSKRSKEIA-NH2 | 2362 |
| JBT1686 | | | Ac-HYHSFYLAVQLHVWERSYEMA-NH2 | 2363 |
| JBT1687 | | | Ac-GYASFWHAVQHHVTKRSREMA-NH2 | 2364 |
| JBT1688 | | | Ac-GYASFTLTVQLHVSKRSKEMA-NH2 | 2365 |
| JBT1689 | | | Ac-GYASFILTVQLHVSKRSKEMA-NH2 | 2366 |
| JBT1690 | | | Ac-GYASFWLAVQIHVSKRSKEMA-NH2 | 2367 |
| JBT1691 | | | Ac-GYASFILAVQHHVSKRSKEMA-NH2 | 2368 |
| JBT1692 | | | Ac-SYASFPPAVMLHVWKRSYEMA-NH2 | 2369 |
| JBT1693 | | | Ac-GYASFNLAVQLHVSKRSKEMA-NH2 | 2370 |
| JBT1694 | | | Ac-GYWSFNLAVQLHVSKRSKEMA-NH2 | 2371 |
| JBT1695 | | | Ac-GYASFFLAVQLHVSKRSKEMA-NH2 | 2372 |
| JBT1696 | | | Ac-GYASFWLAVQMHVWKRSKEMA-NH2 | 2373 |
| JBT1697 | 8481 | F | Ac-GYASFPWFVQLHVHKRSKEMA-NH2 | 223 |
| JBT1698 | | | Ac-GYASFSLAIQLHVSKRSKEMA-NH2 | 2374 |
| JBT1858 | | F | Ac-AYASFPWFVQLHVHKRSWEMA-NH2 | 2024 |
| JBT1859 | | | Ac-GAASFPWFVQLHVHKRSWEMA-NH2 | 2375 |
| JBT1860 | | F | Ac-GYAAFPWFVQLHVHKRSWEMA-NH2 | 2025 |

FIG. 36E

| Object ID | IC50 [nM] | Affinity Class | Sequence | SEQ ID NO: |
|---|---|---|---|---|
| JBT1861 | | | Ac-GYASAPWFVQLHVHKRSWEMA-NH2 | 2376 |
| JBT1862 | | | Ac-GYASFAWFVQLHVHKRSWEMA-NH2 | 2377 |
| JBT1863 | | G | Ac-GYASFPAFVQLHVHKRSWEMA-NH2 | 2147 |
| JBT1864 | | F | Ac-GYASFPWAVQLHVHKRSWEMA-NH2 | 2026 |
| JBT1865 | | | Ac-GYASFPWFAQLHVHKRSWEMA-NH2 | 2378 |
| JBT1866 | | F | Ac-GYASFPWFVALHVHKRSWEMA-NH2 | 2027 |
| JBT1867 | | G | Ac-GYASFPWFVQAHVHKRSWEMA-NH2 | 2148 |
| JBT1868 | | | Ac-GYASFPWFVQLAVHKRSWEMA-NH2 | 2379 |
| JBT1869 | | G | Ac-GYASFPWFVQLHAHKRSWEMA-NH2 | 2149 |
| JBT1870 | | G | Ac-GYASFPWFVQLHVAKRSWEMA-NH2 | 2150 |
| JBT1871 | | | Ac-GYASFPWFVQLHVHARSWEMA-NH2 | 2380 |
| JBT1872 | | | Ac-GYASFPWFVQLHVHKASWEMA-NH2 | 2381 |
| JBT1874 | | | Ac-GYASFPWFVQLHVHKRSAEMA-NH2 | 2382 |
| JBT1875 | | G | Ac-GYASFPWFVQLHVHKRSWAMA-NH2 | 2151 |
| JBT1876 | | G | Ac-GYASFPWFVQLHVHKRSWEAA-NH2 | 2152 |
| JBT1877 | | F | Ac-CYASFPWFVQLHVHKRSWEMA-NH2 | 2028 |
| JBT1878 | | F | Ac-GCASFPWFVQLHVHKRSWEMA-NH2 | 2029 |
| JBT1879 | | F | Ac-GYCSFPWFVQLHVHKRSWEMA-NH2 | 2030 |
| JBT1880 | | F | Ac-GYACFPWFVQLHVHKRSWEMA-NH2 | 2031 |
| JBT1881 | | F | Ac-GYASCPWFVQLHVHKRSWEMA-NH2 | 2032 |
| JBT1882 | | G | Ac-GYASFCWFVQLHVHKRSWEMA-NH2 | 2153 |
| JBT1883 | | F | Ac-GYASFPCFVQLHVHKRSWEMA-NH2 | 2033 |
| JBT1884 | | F | Ac-GYASFPWCVQLHVHKRSWEMA-NH2 | 2034 |
| JBT1885 | | F | Ac-GYASFPWFCQLHVHKRSWEMA-NH2 | 2035 |
| JBT1886 | | | Ac-GYASFPWFVCLHVHKRSWEMA-NH2 | 2236 |
| JBT1888 | | F | Ac-GYASFPWFVQLCVHKRSWEMA-NH2 | 2154 |
| JBT1889 | | G | Ac-GYASFPWFVQLHCHKRSWEMA-NH2 | 2037 |
| JBT1890 | | F | Ac-GYASFPWFVQLHVCKRSWEMA-NH2 | 2038 |
| JBT1891 | | | Ac-GYASFPWFVQLHVHCRSWEMA-NH2 | 2383 |
| JBT1892 | | | Ac-GYASFPWFVQLHVHKCSWEMA-NH2 | 2384 |

FIG. 36F

| Object ID | IC50 [nM] | Affinity Class | Sequence | SEQ ID NO: |
|---|---|---|---|---|
| JBT1893 | | F | Ac-GYASFPWFVQLHVHKRCWEMA-NH2 | 2039 |
| JBT1894 | | F | Ac-GYASFPWFVQLHVHKRSCEMA-NH2 | 2040 |
| JBT1895 | | F | Ac-GYASFPWFVQLHVHKRSWCMA-NH2 | 2041 |
| JBT1896 | | F | Ac-GYASFPWFVQLHVHKRSWECA-NH2 | 2042 |
| JBT1897 | | F | Ac-GYASFPWFVQLHVHKRSWEMC-NH2 | 2043 |
| JBT1898 | | F | Ac-DYASFPWFVQLHVHKRSWEMA-NH2 | 2044 |
| JBT1899 | | G | Ac-GDASFPWFVQLHVHKRSWEMA-NH2 | 2155 |
| JBT1900 | | G | Ac-GYDSFPWFVQLHVHKRSWEMA-NH2 | 2156 |
| JBT1901 | | G | Ac-GYADFPWFVQLHVHKRSWEMA-NH2 | 2157 |
| JBT1902 | | G | Ac-GYASDPWFVQLHVHKRSWEMA-NH2 | 2158 |
| JBT1903 | | | Ac-GYASFDWFVQLHVHKRSWEMA-NH2 | 2385 |
| JBT1904 | | | Ac-GYASFPDFVQLHVHKRSWEMA-NH2 | 2386 |
| JBT1905 | | | Ac-GYASFPWDVQLHVHKRSWEMA-NH2 | 2387 |
| JBT1906 | | | Ac-GYASFPWFDQLHVHKRSWEMA-NH2 | 2388 |
| JBT1907 | | | Ac-GYASFPWFVDLHVHKRSWEMA-NH2 | 2389 |
| JBT1908 | | | Ac-GYASFPWFVQDHVHKRSWEMA-NH2 | 2390 |
| JBT1909 | | | Ac-GYASFPWFVQLDVHKRSWEMA-NH2 | 2391 |
| JBT1910 | | | Ac-GYASFPWFVQLHDHKRSWEMA-NH2 | 2392 |
| JBT1911 | | | Ac-GYASFPWFVQLHVDKRSWEMA-NH2 | 2393 |
| JBT1912 | | | Ac-GYASFPWFVQLHVHDRSWEMA-NH2 | 2394 |
| JBT1913 | | | Ac-GYASFPWFVQLHVHKDSWEMA-NH2 | 2395 |
| JBT1914 | | | Ac-GYASFPWFVQLHVHKRDWEMA-NH2 | 2396 |
| JBT1915 | | | Ac-GYASFPWFVQLHVHKRSDEMA-NH2 | 2397 |
| JBT1916 | | G | Ac-GYASFPWFVQLHVHKRSWDMA-NH2 | 2159 |
| JBT1917 | | | Ac-GYASFPWFVQLHVHKRSWEDA-NH2 | 2398 |
| JBT1918 | | | Ac-GYASFPWFVQLHVHKRSWEMD-NH2 | 2399 |
| JBT1920 | | | Ac-GEASFPWFVQLHVHKRSWEMA-NH2 | 2400 |
| JBT1921 | | G | Ac-GYESFPWFVQLHVHKRSWEMA-NH2 | 2160 |
| JBT1922 | | G | Ac-GYAEFPWFVQLHVHKRSWEMA-NH2 | 2161 |
| JBT1923 | | | Ac-GYASEPWFVQLHVHKRSWEMA-NH2 | 2401 |

FIG. 36G

| Object ID | IC50 [nM] | Affinity Class | Sequence | SEQ ID NO: |
|---|---|---|---|---|
| JBT1924 | | | Ac-GYASFEWFVQLHVHKRSWEMA-NH2 | 2402 |
| JBT1925 | | | Ac-GYASFPEFVQLHVHKRSWEMA-NH2 | 2403 |
| JBT1926 | | | Ac-GYASFPWEVQLHVHKRSWEMA-NH2 | 2404 |
| JBT1927 | | | Ac-GYASFPWFEQLHVHKRSWEMA-NH2 | 2405 |
| JBT1928 | | | Ac-GYASFPWFVELHVHKRSWEMA-NH2 | 2406 |
| JBT1929 | | | Ac-GYASFPWFVQEHVHKRSWEMA-NH2 | 2407 |
| JBT1930 | | | Ac-GYASFPWFVQLEVHKRSWEMA-NH2 | 2408 |
| JBT1931 | | | Ac-GYASFPWFVQLHEHKRSWEMA-NH2 | 2409 |
| JBT1932 | | | Ac-GYASFPWFVQLHVEKRSWEMA-NH2 | 2410 |
| JBT1933 | | | Ac-GYASFPWFVQLHVHERSWEMA-NH2 | 2411 |
| JBT1934 | | | Ac-GYASFPWFVQLHVHKESWEMA-NH2 | 2412 |
| JBT1935 | | | Ac-GYASFPWFVQLHVHKREWEMA-NH2 | 2413 |
| JBT1936 | | | Ac-GYASFPWFVQLHVHKRSEEMA-NH2 | 2414 |
| JBT1937 | | | Ac-GYASFPWFVQLHVHKRSWEEA-NH2 | 2415 |
| JBT1938 | | | Ac-GYASFPWFVQLHVHKRSWEME-NH2 | 2416 |
| JBT1939 | | G | Ac-FYASFPWFVQLHVHKRSWEMA-NH2 | 2162 |
| JBT1940 | | G | Ac-GFASFPWFVQLHVHKRSWEMA-NH2 | 2163 |
| JBT1941 | | G | Ac-GYFSFPWFVQLHVHKRSWEMA-NH2 | 2164 |
| JBT1942 | | G | Ac-GYAFFPWFVQLHVHKRSWEMA-NH2 | 2165 |
| JBT1943 | | | Ac-GYASFFWFVQLHVHKRSWEMA-NH2 | 2417 |
| JBT1944 | | G | Ac-GYASFPPFVQLHVHKRSWEMA-NH2 | 2166 |
| JBT1945 | | G | Ac-GYASFPWFFQLHVHKRSWEMA-NH2 | 2167 |
| JBT1946 | | G | Ac-GYASFPWFVFLHVHKRSWEMA-NH2 | 2168 |
| JBT1948 | | | Ac-GYASFPWFVQLFVHKRSWEMA-NH2 | 2418 |
| JBT1949 | | G | Ac-GYASFPWFVQLHFHKRSWEMA-NH2 | 2169 |
| JBT1950 | | F | Ac-GYASFPWFVQLHVFKRSWEMA-NH2 | 2045 |
| JBT1951 | | | Ac-GYASFPWFVQLHVHFRSWEMA-NH2 | 2419 |
| JBT1952 | | G | Ac-GYASFPWFVQLHVHKFSWEMA-NH2 | 2170 |
| JBT1953 | | G | Ac-GYASFPWFVQLHVHKRFWEMA-NH2 | 2171 |
| JBT1954 | | G | Ac-GYASFPWFVQLHVHKRSFEMA-NH2 | 2172 |

FIG. 36H

| Object ID | IC50 [nM] | Affinity Class | Sequence | SEQ ID NO: |
|---|---|---|---|---|
| JBT1955 | | G | Ac-GYASFPWFVQLHVHKRSWFMA-NH2 | 2173 |
| JBT1956 | | G | Ac-GYASFPWFVQLHVHKRSWEFA-NH2 | 2174 |
| JBT1959 | | F | Ac-GYGSFPWFVQLHVHKRSWEMA-NH2 | 2046 |
| JBT1960 | | F | Ac-GYAGFPWFVQLHVHKRSWEMA-NH2 | 2047 |
| JBT1961 | | G | Ac-GYASGPWFVQLHVHKRSWEMA-NH2 | 2175 |
| JBT1962 | | | Ac-GYASFGWFVQLHVHKRSWEMA-NH2 | 2420 |
| JBT1963 | | G | Ac-GYASFPGFVQLHVHKRSWEMA-NH2 | 2176 |
| JBT1964 | | G | Ac-GYASFPWGVQLHVHKRSWEMA-NH2 | 2177 |
| JBT1965 | | G | Ac-GYASFPWFGQLHVHKRSWEMA-NH2 | 2178 |
| JBT1966 | | G | Ac-GYASFPWFVGLHVHKRSWEMA-NH2 | 2179 |
| JBT1967 | | G | Ac-GYASFPWFVQGHVHKRSWEMA-NH2 | 2180 |
| JBT1968 | | | Ac-GYASFPWFVQLGVHKRSWEMA-NH2 | 2421 |
| JBT1969 | | G | Ac-GYASFPWFVQLHGHKRSWEMA-NH2 | 2181 |
| JBT1970 | | G | Ac-GYASFPWFVQLHVGKRSWEMA-NH2 | 2182 |
| JBT1971 | | | Ac-GYASFPWFVQLHVHGRSWEMA-NH2 | 2422 |
| JBT1972 | | | Ac-GYASFPWFVQLHVHKGSWEMA-NH2 | 2423 |
| JBT1973 | | F | Ac-GYASFPWFVQLHVHKRGWEMA-NH2 | 2048 |
| JBT1974 | | | Ac-GYASFPWFVQLHVHKRSGEMA-NH2 | 2424 |
| JBT1975 | | G | Ac-GYASFPWFVQLHVHKRSWGMA-NH2 | 2183 |
| JBT1976 | | G | Ac-GYASFPWFVQLHVHKRSWEGA-NH2 | 2184 |
| JBT1979 | | G | Ac-GHASFPWFVQLHVHKRSWEMA-NH2 | 2185 |
| JBT1980 | | F | Ac-GYHSFPWFVQLHVHKRSWEMA-NH2 | 2049 |
| JBT1981 | | F | Ac-GYAHFPWFVQLHVHKRSWEMA-NH2 | 2050 |
| JBT1982 | | F | Ac-GYASHPWFVQLHVHKRSWEMA-NH2 | 2051 |
| JBT1984 | | G | Ac-GYASFPHFVQLHVHKRSWEMA-NH2 | 2186 |
| JBT1985 | | F | Ac-GYASFPWHVQLHVHKRSWEMA-NH2 | 2052 |
| JBT1986 | | G | Ac-GYASFPWFHQLHVHKRSWEMA-NH2 | 2187 |
| JBT1987 | | G | Ac-GYASFPWFVHLHVHKRSWEMA-NH2 | 2188 |
| JBT1989 | | G | Ac-GYASFPWFVQLHHHKRSWEMA-NH2 | 2189 |
| JBT1990 | | | Ac-GYASFPWFVQLHVHHRSWEMA-NH2 | 2425 |

FIG. 361

| Object ID | IC50 [nM] | Affinity Class | Sequence | SEQ ID NO: |
|---|---|---|---|---|
| JBT1991 | | | Ac-GYASFPWFVQLHVHKHSWEMA-NH2 | 2426 |
| JBT1993 | | | Ac-GYASFPWFVQLHVHKRSHEMA-NH2 | 2427 |
| JBT1994 | | F | Ac-GYASFPWFVQLHVHKRSWHMA-NH2 | 2053 |
| JBT1995 | | G | Ac-GYASFPWFVQLHVHKRSWEHA-NH2 | 2190 |
| JBT1996 | | F | Ac-GYASFPWFVQLHVHKRSWEMH-NH2 | 2054 |
| JBT1997 | | G | Ac-IYASFPWFVQLHVHKRSWEMA-NH2 | 2191 |
| JBT1999 | | F | Ac-GYISFPWFVQLHVHKRSWEMA-NH2 | 2055 |
| JBT2000 | | F | Ac-GYAIFPWFVQLHVHKRSWEMA-NH2 | 2056 |
| JBT2001 | | G | Ac-GYASIPWFVQLHVHKRSWEMA-NH2 | 2192 |
| JBT2002 | | | Ac-GYASFIWFVQLHVHKRSWEMA-NH2 | 2428 |
| JBT2003 | | G | Ac-GYASFPIFVQLHVHKRSWEMA-NH2 | 2193 |
| JBT2005 | | G | Ac-GYASFPWFIQLHVHKRSWEMA-NH2 | 2194 |
| JBT2006 | | G | Ac-GYASFPWFVILHVHKRSWEMA-NH2 | 2195 |
| JBT2007 | | F | Ac-GYASFPWFVQIHVHKRSWEMA-NH2 | 2057 |
| JBT2008 | | G | Ac-GYASFPWFVQLIVHKRSWEMA-NH2 | 2196 |
| JBT2010 | | F | Ac-GYASFPWFVQLHIHKRSWEMA-NH2 | 2058 |
| JBT2011 | | | Ac-GYASFPWFVQLHVIKRSWEMA-NH2 | 2429 |
| JBT2012 | | | Ac-GYASFPWFVQLHVHIRSWEMA-NH2 | 2430 |
| JBT2013 | | F | Ac-GYASFPWFVQLHVHKISWEMA-NH2 | 2059 |
| JBT2014 | | F | Ac-GYASFPWFVQLHVHKRIWEMA-NH2 | 2060 |
| JBT2017 | | F | Ac-GYASFPWFVQLHVHKRSIEMA-NH2 | 2061 |
| JBT2018 | | F | Ac-GYASFPWFVQLHVHKRSWEMI-NH2 | 2062 |
| JBT2019 | | F | Ac-KYASFPWFVQLHVHKRSWEMA-NH2 | 2063 |
| JBT2020 | | F | Ac-GKASFPWFVQLHVHKRSWEMA-NH2 | 2064 |
| JBT2021 | | F | Ac-GYAKFPWFVQLHVHKRSWEMA-NH2 | 2065 |
| JBT2022 | | F | Ac-GYASKPWFVQLHVHKRSWEMA-NH2 | 2066 |
| JBT2023 | | G | Ac-GYASFKWFVQLHVHKRSWEMA-NH2 | 2197 |
| JBT2024 | | G | Ac-GYASFPKFVQLHVHKRSWEMA-NH2 | 2198 |
| JBT2025 | | F | Ac-GYASFPWKVQLHVHKRSWEMA-NH2 | 2067 |
| JBT2027 | | F | Ac-GYASFPWFVKLHVHKRSWEMA-NH2 | 2068 |

FIG. 36J

| Object ID | IC50 [nM] | Affinity Class | Sequence | SEQ ID NO: |
|---|---|---|---|---|
| JBT2028 | | F | Ac-GYASFPWFVQKHVHKRSWEMA-NH2 | 2069 |
| JBT2029 | | G | Ac-GYASFPWFVQLKVHKRSWEMA-NH2 | 2199 |
| JBT2030 | | F | Ac-GYASFPWFVQLHKHKRSWEMA-NH2 | 2070 |
| JBT2032 | | | Ac-GYASFPWFVQLHVHKKSWEMA-NH2 | 2431 |
| JBT2033 | | F | Ac-GYASFPWFVQLHVHKRKWEMA-NH2 | 2071 |
| JBT2034 | | G | Ac-GYASFPWFVQLHVHKRSKEMA-NH2 | 2200 |
| JBT2035 | | F | Ac-GYASFPWFVQLHVHKRSWKMA-NH2 | 2072 |
| JBT2036 | | G | Ac-GYASFPWFVQLHVHKRSWEKA-NH2 | 2201 |
| JBT2037 | | F | Ac-GYASFPWFVQLHVHKRSWEMK-NH2 | 2073 |
| JBT2038 | | F | Ac-LYASFPWFVQLHVHKRSWEMA-NH2 | 2074 |
| JBT2040 | | F | Ac-GYLSFPWFVQLHVHKRSWEMA-NH2 | 2075 |
| JBT2041 | | F | Ac-GYALFPWFVQLHVHKRSWEMA-NH2 | 2076 |
| JBT2042 | | G | Ac-GYASLPWFVQLHVHKRSWEMA-NH2 | 2202 |
| JBT2043 | | | Ac-GYASFLWFVQLHVHKRSWEMA-NH2 | 2432 |
| JBT2044 | | G | Ac-GYASFPLFVQLHVHKRSWEMA-NH2 | 2203 |
| JBT2045 | | G | Ac-GYASFPWLVQLHVHKRSWEMA-NH2 | 2204 |
| JBT2046 | | G | Ac-GYASFPWFLQLHVHKRSWEMA-NH2 | 2205 |
| JBT2047 | | F | Ac-GYASFPWFVLLHVHKRSWEMA-NH2 | 2077 |
| JBT2048 | | G | Ac-GYASFPWFVQLLVHKRSWEMA-NH2 | 2206 |
| JBT2049 | | G | Ac-GYASFPWFVQLHLHKRSWEMA-NH2 | 2207 |
| JBT2050 | | G | Ac-GYASFPWFVQLHVLKRSWEMA-NH2 | 2208 |
| JBT2051 | | | Ac-GYASFPWFVQLHVHLRSWEMA-NH2 | 2433 |
| JBT2052 | | | Ac-GYASFPWFVQLHVHKLSWEMA-NH2 | 2434 |
| JBT2053 | | F | Ac-GYASFPWFVQLHVHKRLWEMA-NH2 | 2078 |
| JBT2054 | | G | Ac-GYASFPWFVQLHVHKRSLEMA-NH2 | 2209 |
| JBT2055 | | G | Ac-GYASFPWFVQLHVHKRSWLMA-NH2 | 2210 |
| JBT2056 | | G | Ac-GYASFPWFVQLHVHKRSWELA-NH2 | 2211 |
| JBT2057 | | F | Ac-GYASFPWFVQLHVHKRSWEML-NH2 | 2079 |
| JBT2058 | | F | Ac-MYASFPWFVQLHVHKRSWEMA-NH2 | 2080 |
| JBT2059 | | G | Ac-GMASFPWFVQLHVHKRSWEMA-NH2 | 2212 |

FIG. 36K

| Object ID | IC50 [nM] | Affinity Class | Sequence | SEQ ID NO: |
|---|---|---|---|---|
| JBT2060 | | F | Ac-GYMSFPWFVQLHVHKRSWEMA-NH2 | 2081 |
| JBT2061 | | F | Ac-GYAMFPWFVQLHVHKRSWEMA-NH2 | 2082 |
| JBT2062 | | G | Ac-GYASMPWFVQLHVHKRSWEMA-NH2 | 2213 |
| JBT2063 | | | Ac-GYASFMWFVQLHVHKRSWEMA-NH2 | 2435 |
| JBT2064 | | | Ac-GYASFPMFVQLHVHKRSWEMA-NH2 | 2436 |
| JBT2065 | | G | Ac-GYASFPWMVQLHVHKRSWEMA-NH2 | 2214 |
| JBT2066 | | G | Ac-GYASFPWFMQLHVHKRSWEMA-NH2 | 2215 |
| JBT2067 | | G | Ac-GYASFPWFVMLHVHKRSWEMA-NH2 | 2216 |
| JBT2068 | | F | Ac-GYASFPWFVQMHVHKRSWEMA-NH2 | 2083 |
| JBT2069 | | | Ac-GYASFPWFVQLMVHKRSWEMA-NH2 | 2437 |
| JBT2070 | | G | Ac-GYASFPWFVQLHMHKRSWEMA-NH2 | 2217 |
| JBT2071 | | G | Ac-GYASFPWFVQLHVMKRSWEMA-NH2 | 2218 |
| JBT2072 | | | Ac-GYASFPWFVQLHVHMRSWEMA-NH2 | 2438 |
| JBT2073 | | | Ac-GYASFPWFVQLHVHKMSWEMA-NH2 | 2439 |
| JBT2075 | | G | Ac-GYASFPWFVQLHVHKRSMEMA-NH2 | 2219 |
| JBT2076 | | | Ac-GYASFPWFVQLHVHKRSWMMA-NH2 | 2440 |
| JBT2077 | | F | Ac-GYASFPWFVQLHVHKRSWEMM-NH2 | 2084 |
| JBT2078 | | F | Ac-NYASFPWFVQLHVHKRSWEMA-NH2 | 2085 |
| JBT2079 | | G | Ac-GNASFPWFVQLHVHKRSWEMA-NH2 | 2220 |
| JBT2080 | | G | Ac-GYNSFPWFVQLHVHKRSWEMA-NH2 | 2221 |
| JBT2081 | | F | Ac-GYANFPWFVQLHVHKRSWEMA-NH2 | 2086 |
| JBT2082 | | G | Ac-GYASNPWFVQLHVHKRSWEMA-NH2 | 2222 |
| JBT2083 | | | Ac-GYASFNWFVQLHVHKRSWEMA-NH2 | 2441 |
| JBT2084 | | G | Ac-GYASFPNFVQLHVHKRSWEMA-NH2 | 2223 |
| JBT2085 | | G | Ac-GYASFPWNVQLHVHKRSWEMA-NH2 | 2224 |
| JBT2086 | | | Ac-GYASFPWFNQLHVHKRSWEMA-NH2 | 2442 |
| JBT2087 | | G | Ac-GYASFPWFVNLHVHKRSWEMA-NH2 | 2225 |
| JBT2088 | | G | Ac-GYASFPWFVQNHVHKRSWEMA-NH2 | 2226 |
| JBT2089 | | | Ac-GYASFPWFVQLNVHKRSWEMA-NH2 | 2443 |
| JBT2090 | | | Ac-GYASFPWFVQLHNHKRSWEMA-NH2 | 2444 |

FIG. 36L

| Object ID | IC50 [nM] | Affinity Class | Sequence | SEQ ID NO: |
|---|---|---|---|---|
| JBT2091 | | G | Ac-GYASFPWFVQLHVNKRSWEMA-NH2 | 2227 |
| JBT2092 | | | Ac-GYASFPWFVQLHVHNRSWEMA-NH2 | 2445 |
| JBT2093 | | | Ac-GYASFPWFVQLHVHKNSWEMA-NH2 | 2446 |
| JBT2094 | | F | Ac-GYASFPWFVQLHVHKRNWEMA-NH2 | 2087 |
| JBT2095 | | | Ac-GYASFPWFVQLHVHKRSNEMA-NH2 | 2447 |
| JBT2096 | | G | Ac-GYASFPWFVQLHVHKRSWNMA-NH2 | 2228 |
| JBT2097 | | G | Ac-GYASFPWFVQLHVHKRSWENA-NH2 | 2229 |
| JBT2098 | | F | Ac-GYASFPWFVQLHVHKRSWEMN-NH2 | 2088 |
| JBT2099 | | F | Ac-PYASFPWFVQLHVHKRSWEMA-NH2 | 2089 |
| JBT2100 | | G | Ac-GPASFPWFVQLHVHKRSWEMA-NH2 | 2230 |
| JBT2101 | | G | Ac-GYPSFPWFVQLHVHKRSWEMA-NH2 | 2231 |
| JBT2103 | | G | Ac-GYASPPWFVQLHVHKRSWEMA-NH2 | 2232 |
| JBT2104 | | | Ac-GYASFPPFVQLHVHKRSWEMA-NH2 | 2448 |
| JBT2105 | | G | Ac-GYASFPWPVQLHVHKRSWEMA-NH2 | 2233 |
| JBT2106 | | | Ac-GYASFPWFPQLHVHKRSWEMA-NH2 | 2449 |
| JBT2107 | | G | Ac-GYASFPWFVPLHVHKRSWEMA-NH2 | 2234 |
| JBT2108 | | | Ac-GYASFPWFVQPHVHKRSWEMA-NH2 | 2450 |
| JBT2109 | | | Ac-GYASFPWFVQLPVHKRSWEMA-NH2 | 2451 |
| JBT2110 | | | Ac-GYASFPWFVQLHPHKRSWEMA-NH2 | 2452 |
| JBT2111 | | | Ac-GYASFPWFVQLHVPKRSWEMA-NH2 | 2453 |
| JBT2112 | | | Ac-GYASFPWFVQLHVHPRSWEMA-NH2 | 2454 |
| JBT2113 | | | Ac-GYASFPWFVQLHVHKPSWEMA-NH2 | 2455 |
| JBT2114 | | | Ac-GYASFPWFVQLHVHKRPWEMA-NH2 | 2456 |
| JBT2115 | | | Ac-GYASFPWFVQLHVHKRSPEMA-NH2 | 2457 |
| JBT2116 | | G | Ac-GYASFPWFVQLHVHKRSWPMA-NH2 | 2235 |
| JBT2118 | | G | Ac-GYASFPWFVQLHVHKRSWEMP-NH2 | 2236 |
| JBT2119 | | G | Ac-QYASFPWFVQLHVHKRSWEMA-NH2 | 2237 |
| JBT2120 | | | Ac-GQASFPWFVQLHVHKRSWEMA-NH2 | 2458 |
| JBT2121 | | G | Ac-GYQSFPWFVQLHVHKRSWEMA-NH2 | 2238 |
| JBT2122 | | G | Ac-GYAQPWFVQLHVHKRSWEMA-NH2 | 2239 |

FIG. 36M

| Object ID | IC50 [nM] | Affinity Class | Sequence | SEQ ID NO: |
|---|---|---|---|---|
| JBT2123 | | G | Ac-GYASQPWFVQLHVHKRSWEMA-NH2 | 2240 |
| JBT2124 | | | Ac-GYASFQWFVQLHVHKRSWEMA-NH2 | 2459 |
| JBT2125 | | | Ac-GYASFPQFVQLHVHKRSWEMA-NH2 | 2460 |
| JBT2126 | | G | Ac-GYASFPWQVQLHVHKRSWEMA-NH2 | 2241 |
| JBT2127 | | | Ac-GYASFPWFQQLHVHKRSWEMA-NH2 | 2461 |
| JBT2128 | | G | Ac-GYASFPWFVQQHVHKRSWEMA-NH2 | 2242 |
| JBT2129 | | | Ac-GYASFPWFVQLQVHKRSWEMA-NH2 | 2462 |
| JBT2130 | | | Ac-GYASFPWFVQLHQHKRSWEMA-NH2 | 2463 |
| JBT2131 | | G | Ac-GYASFPWFVQLHVQKRSWEMA-NH2 | 2243 |
| JBT2132 | | | Ac-GYASFPWFVQLHVHQRSWEMA-NH2 | 2464 |
| JBT2133 | | | Ac-GYASFPWFVQLHVHKQSWEMA-NH2 | 2465 |
| JBT2134 | | F | Ac-GYASFPWFVQLHVHKRQWEMA-NH2 | 2090 |
| JBT2135 | | G | Ac-GYASFPWFVQLHVHKRSQEMA-NH2 | 2244 |
| JBT2136 | | G | Ac-GYASFPWFVQLHVHKRSWQMA-NH2 | 2245 |
| JBT2137 | | G | Ac-GYASFPWFVQLHVHKRSWEQA-NH2 | 2246 |
| JBT2138 | | F | Ac-GYASFPWFVQLHVHKRSWEMQ-NH2 | 2091 |
| JBT2139 | | F | Ac-RYASFPWFVQLHVHKRSWEMA-NH2 | 2092 |
| JBT2140 | | F | Ac-GRASFPWFVQLHVHKRSWEMA-NH2 | 2093 |
| JBT2141 | | F | Ac-GYRSFPWFVQLHVHKRSWEMA-NH2 | 2094 |
| JBT2142 | | F | Ac-GYARFPWFVQLHVHKRSWEMA-NH2 | 2095 |
| JBT2143 | | F | Ac-GYASRPWFVQLHVHKRSWEMA-NH2 | 2096 |
| JBT2144 | | G | Ac-GYASFRWFVQLHVHKRSWEMA-NH2 | 2247 |
| JBT2145 | | F | Ac-GYASFPRFVQLHVHKRSWEMA-NH2 | 2097 |
| JBT2146 | | F | Ac-GYASFPWRVQLHVHKRSWEMA-NH2 | 2098 |
| JBT2147 | | F | Ac-GYASFPWFRQLHVHKRSWEMA-NH2 | 2099 |
| JBT2148 | | F | Ac-GYASFPWFVRLHVHKRSWEMA-NH2 | 2100 |
| JBT2149 | | F | Ac-GYASFPWFVQRHVHKRSWEMA-NH2 | 2101 |
| JBT2150 | | G | Ac-GYASFPWFVQLRVHKRSWEMA-NH2 | 2248 |
| JBT2151 | | F | Ac-GYASFPWFVQLHRHKRSWEMA-NH2 | 2102 |
| JBT2152 | | F | Ac-GYASFPWFVQLHVRKRSWEMA-NH2 | 2103 |

FIG. 36N

| Object ID | IC50 [nM] | Affinity Class | Sequence | SEQ ID NO: |
|---|---|---|---|---|
| JBT2153 | | F | Ac-GYASFPWFVQLHVHRRSWEMA-NH2 | 2104 |
| JBT2154 | | F | Ac-GYASFPWFVQLHVHKRRWEMA-NH2 | 2105 |
| JBT2155 | | F | Ac-GYASFPWFVQLHVHKRSREMA-NH2 | 2106 |
| JBT2156 | | F | Ac-GYASFPWFVQLHVHKRSWRMA-NH2 | 2107 |
| JBT2157 | | G | Ac-GYASFPWFVQLHVHKRSWERA-NH2 | 2249 |
| JBT2158 | | F | Ac-GYASFPWFVQLHVHKRSWEMR-NH2 | 2108 |
| JBT2159 | | F | Ac-SYASFPWFVQLHVHKRSWEMA-NH2 | 2109 |
| JBT2160 | | G | Ac-GSASFPWFVQLHVHKRSWEMA-NH2 | 2250 |
| JBT2161 | | F | Ac-GYSSFPWFVQLHVHKRSWEMA-NH2 | 2110 |
| JBT2162 | | G | Ac-GYASSPWFVQLHVHKRSWEMA-NH2 | 2251 |
| JBT2163 | | | Ac-GYASFSWFVQLHVHKRSWEMA-NH2 | 2466 |
| JBT2164 | | G | Ac-GYASFPSFVQLHVHKRSWEMA-NH2 | 2252 |
| JBT2165 | | G | Ac-GYASFPWSVQLHVHKRSWEMA-NH2 | 2253 |
| JBT2166 | | G | Ac-GYASFPWFSQLHVHKRSWEMA-NH2 | 2254 |
| JBT2167 | | F | Ac-GYASFPWFVSLHVHKRSWEMA-NH2 | 2111 |
| JBT2168 | | G | Ac-GYASFPWFVQSHVHKRSWEMA-NH2 | 2255 |
| JBT2169 | | | Ac-GYASFPWFVQLSVHKRSWEMA-NH2 | 2467 |
| JBT2170 | | G | Ac-GYASFPWFVQLHSHKRSWEMA-NH2 | 2256 |
| JBT2171 | | G | Ac-GYASFPWFVQLHVSKRSWEMA-NH2 | 2257 |
| JBT2172 | | | Ac-GYASFPWFVQLHVHSRSWEMA-NH2 | 2468 |
| JBT2173 | | | Ac-GYASFPWFVQLHVHKSSWEMA-NH2 | 2469 |
| JBT2174 | | | Ac-GYASFPWFVQLHVHKRSSEMA-NH2 | 2470 |
| JBT2175 | | | Ac-GYASFPWFVQLHVHKRSWSMA-NH2 | 2471 |
| JBT2176 | | | Ac-GYASFPWFVQLHVHKRSWESA-NH2 | 2472 |
| JBT2177 | | | Ac-GYASFPWFVQLHVHKRSWEMS-NH2 | 2473 |
| JBT2178 | | F | Ac-TYASFPWFVQLHVHKRSWEMA-NH2 | 2112 |
| JBT2179 | | G | Ac-GTASFPWFVQLHVHKRSWEMA-NH2 | 2258 |
| JBT2180 | | F | Ac-GYTSFPWFVQLHVHKRSWEMA-NH2 | 2113 |
| JBT2181 | | F | Ac-GYATFPWFVQLHVHRRSWEMA-NH2 | 2114 |
| JBT2182 | | G | Ac-GYASTPWFVQLHVHKRSWEMA-NH2 | 2259 |

FIG. 36O

| Object ID | IC50 [nM] | Affinity Class | Sequence | SEQ ID NO: |
|---|---|---|---|---|
| JBT2183 | | | Ac-GYASFTWFVQLHVHKRSWEMA-NH2 | 2474 |
| JBT2184 | | G | Ac-GYASFPTFVQLIIVHKRSWEMA-NH2 | 2260 |
| JBT2185 | | G | Ac-GYASFPWTVQLHVHKRSWEMA-NH2 | 2261 |
| JBT2186 | | G | Ac-GYASFPWFTQLHVHKRSWEMA-NH2 | 2262 |
| JBT2187 | | G | Ac-GYASFPWFVTLHVHKRSWEMA-NH2 | 2263 |
| JBT2188 | | G | Ac-GYASFPWFVQTHVHKRSWEMA-NH2 | 2264 |
| JBT2189 | | | Ac-GYASFPWFVQLTVIIKRSWEMA-NH2 | 2475 |
| JBT2190 | | | Ac-GYASFPWFVQLHTHKRSWEMA-NH2 | 2476 |
| JBT2191 | | G | Ac-GYASFPWFVQLHVTKRSWEMA-NH2 | 2265 |
| JBT2192 | | | Ac-GYASFPWFVQLHVHTRSWEMA-NH2 | 2477 |
| JBT2193 | | | Ac-GYASFPWFVQLHVHKTSWEMA-NH2 | 2478 |
| JBT2194 | | F | Ac-GYASFPWFVQLHVHKRTWEMA-NH2 | 2115 |
| JBT2195 | | | Ac-GYASFPWFVQLHVHKRSTEMA-NH2 | 2479 |
| JBT2196 | | | Ac-GYASFPWFVQLHVHKRSWTMA-NH2 | 2480 |
| JBT2197 | | | Ac-GYASFPWFVQLHVHKRSWETA-NH2 | 2481 |
| JBT2198 | | G | Ac-GYASFPWFVQLHVHKRSWEMT-NH2 | 2266 |
| JBT2199 | | | Ac-VYASFPWFVQLHVHKRSWEMA-NH2 | 2482 |
| JBT2200 | | | Ac-GYVSFPWFVQLHVHKRSWEMA-NH2 | 2483 |
| JBT2201 | | | Ac-GYAVFPWFVQLHVHKRSWEMA-NH2 | 2484 |
| JBT2202 | | G | Ac-GYASVPWFVQLIIVHKRSWEMA-NH2 | 2267 |
| JBT2203 | | G | Ac-GYASFVWFVQLHVHKRSWEMA-NH2 | 2268 |
| JBT2204 | | | Ac-GYASFPVFVQLHVHKRSWEMA-NH2 | 2485 |
| JBT2205 | | | Ac-GYASFPVFVQLHVHKRSWEMA-NH2 | 2486 |
| JBT2206 | | F | Ac-GYASFPWVVQLHVHKRSWEMA-NH2 | 2116 |
| JBT2207 | | G | Ac-GYASFPWFVLHVLHVHKRSWEMA-NH2 | 2269 |
| JBT2208 | | F | Ac-GYASFPWFVQVHVHKRSWEMA-NH2 | 2117 |
| JBT2209 | | | Ac-GYASFPWFVQLVVHKRSWEMA-NH2 | 2487 |
| JBT2210 | | G | Ac-GYASFPWFVQLHVKRSWEMA-NH2 | 2270 |
| JBT2211 | | | Ac-GYASFPWFVQLHVHVRSWEMA-NH2 | 2488 |
| JBT2212 | | | Ac-GYASFPWFVQLHVIIKVSWEMA-NH2 | 2489 |

FIG. 36P

| Object ID | IC50 [nM] | Affinity Class | Sequence | SEQ ID NO: |
|---|---|---|---|---|
| JBT2213 | | F | Ac-GYASFPWFVQLHVHKRVWEMA-NH2 | 2118 |
| JBT2214 | | G | Ac-GYASFPWFVQLHVHKRSVEMA-NH2 | 2271 |
| JBT2215 | | G | Ac-GYASFPWFVQLHVHKRSWVMA-NH2 | 2272 |
| JBT2216 | | G | Ac-GYASFPWFVQLHVHKRSWEVA-NH2 | 2273 |
| JBT2217 | | F | Ac-GYASFPWFVQLHVHKRSWEMV-NH2 | 2119 |
| JBT2218 | | G | Ac-WYASFPWFVQLHVIIKRSWEMA-NH2 | 2274 |
| JBT2219 | | F | Ac-GWASFPWFVQLHVHKRSWEMA-NH2 | 2120 |
| JBT2220 | | F | Ac-GYWSFPWFVQLHVHKRSWEMA-NH2 | 2121 |
| JBT2221 | | G | Ac-GYAWFPWFVQLHVHKRSWEMA-NH2 | 2275 |
| JBT2222 | | F | Ac-GYASWPWFVQLHVHKRSWEMA-NH2 | 2122 |
| JBT2223 | | | Ac-GYASFWWFVQLHVHKRSWEMA-NH2 | 2490 |
| JBT2224 | | F | Ac-GYASFPWWVQLHVHKRSWEMA-NH2 | 2123 |
| JBT2225 | | G | Ac-GYASFPWFWQLHVHKRSWEMA-NH2 | 2276 |
| JBT2226 | | G | Ac-GYASFPWFVWLHVHKRSWEMA-NH2 | 2277 |
| JBT2227 | | F | Ac-GYASFPWFVQWHVHKRSWEMA-NH2 | 2124 |
| JBT2228 | | | Ac-GYASFPWFVQLWVHKRSWEMA-NH2 | 2491 |
| JBT2229 | | G | Ac-GYASFPWFVQLHVWKRSWEMA-NH2 | 2278 |
| JBT2230 | | G | Ac-GYASFPWFVQLHVHWRSWEMA-NH2 | 2279 |
| JBT2231 | | | Ac-GYASFPWFVQLHVHKWSWEMA-NH2 | 2492 |
| JBT2232 | | | Ac-GYASFPWFVQLHVHKRWWEMA-NH2 | 2493 |
| JBT2233 | | G | Ac-GYASFPWFVQLHVHKRSWWMA-NH2 | 2280 |
| JBT2234 | | G | Ac-GYASFPWFVQLHVHKRSWEWA-NH2 | 2281 |
| JBT2235 | | G | Ac-GYASFPWFVQLHVHKRSWEMW-NH2 | 2282 |
| JBT2236 | | F | Ac-GYASFPWFVQLHVHKRSWEMW-NH2 | 2125 |
| JBT2238 | | G | Ac-GYYSFPWFVQLHVHKRSWEMA-NH2 | 2283 |
| JBT2239 | | G | Ac-GYAYFPWFVQLHVHKRSWEMA-NH2 | 2284 |
| JBT2240 | | G | Ac-GYASYPWFVQLHVHKRSWEMA-NH2 | 2285 |
| JBT2241 | | | Ac-GYASFYWFVQLHVHKRSWEMA-NH2 | 2494 |
| JBT2242 | | G | Ac-GYASFPYFVQLHVHKRSWEMA-NH2 | 2286 |
| JBT2243 | | F | Ac-GYASFPWYVQLHVHKRSWEMA-NH2 | 2126 |

FIG. 36Q

| Object ID | IC50 [nM] | Affinity Class | Sequence | SEQ ID NO: |
|---|---|---|---|---|
| JBT2244 | | G | Ac-GYASFPWFYQLHVHKRSWEMA-NH2 | 2287 |
| JBT2245 | | G | Ac-GYASFPWFVYLHVHKRSWEMA-NH2 | 2288 |
| JBT2246 | | G | Ac-GYASFPWFVQYHVHKRSWEMA-NH2 | 2289 |
| JBT2247 | | | Ac-GYASFPWFVQLYVHKRSWEMA-NH2 | 2495 |
| JBT2248 | | G | Ac-GYASFPWFVQLHYHKRSWEMA-NH2 | 2290 |
| JBT2249 | | G | Ac-GYASFPWFVQLHVYKRSWEMA-NH2 | 2291 |
| JBT2250 | | | Ac-GYASFPWFVQLHVHYRSWEMA-NH2 | 2496 |
| JBT2251 | | | Ac-GYASFPWFVQLHVHKYSWEMA-NH2 | 2497 |
| JBT2252 | | G | Ac-GYASFPWFVQLHVHKRYWEMA-NH2 | 2292 |
| JBT2253 | | G | Ac-GYASFPWFVQLHVHKRSYEMA-NH2 | 2293 |
| JBT2254 | | G | Ac-GYASFPWFVQLHVHKRSWYMA-NH2 | 2294 |
| JBT2255 | | G | Ac-GYASFPWFVQLHVHKRSWEYA-NH2 | 2295 |
| JBT2256 | | G | Ac-GYASFPWFVQLHVHKRSWEMY-NH2 | 2296 |

FIGURE 37

| Object ID | EC50 [nM] | Sequence | SEQ ID NO: |
|---|---|---|---|
| JBT0126 | 55.6868 | Biotinyl-Ttds-SGYASFPLAVQLHVSKRSKEMALARLYYKTS-NH2 | 2498 |

FIG. 38A

| Object ID | IC50 Mean (nM) | Affinity Class | Sequence | SEQ ID NO: |
|---|---|---|---|---|
| JBT0049 | ND | | Ac-SGNTFVDERLLYFLTIGNMGMYAAQLKFRTS-NH2 | 3025 |
| JBT0050 | 2745 | E | Ac-SGRGCTKVIVFTFRHNKLIGYERRYNCTS-NH2 | 3047 |
| JBT0101 | 251 | D | Ac-KKSGVWQTHPRYFWTMWPDIKGEVIVLFGTSKK-NH2 | 3036 |
| JBT0129 | ND | | Ac-SGRG|CTKVIVFTFRHNKLIGYERRYNC|TS-NH2 | 3026 |
| JBT0176* | 39444 | G | Ac-KKVGSVTRWSMYGPIFIKFTWTLEQPVGWDHKK-NH2 | 3056 |
| JBT0177* | >50000 | | Ac-KKLTGDWTYFWSKVIWGPCVIERQMPVSTFHKK-NH2 | 3065 |
| JBT0178 | 72 | B | Ac-KKSGVWQTHPRYFWTMWPDIKGEVIVLFGTKK-NH2 | 3028 |
| JBT0179 | >50000 | | Ac-KKSGVWQTHPRYFWTMWPDIKGEVIVLKK-NH2 | 3066 |
| JBT0180 | >50000 | | Ac-KKSGVWQTHPRYFWTMWPDIKGEVKK-NH2 | 3067 |
| JBT0181 | >50000 | | Ac-KKSGVWQTHPRYFWTMWPDIKKK-NH2 | 3068 |
| JBT0182 | 351 | D | Ac-KKGVWQTHPRYFWTMWPDIKGEVIVLFGTSKK-NH2 | 3037 |
| JBT0183 | >50000 | | Ac-KKQTHPRYFWTMWPDIKGEVIVLFGTSKK-NH2 | 3069 |
| JBT0184 | >50000 | | Ac-KKPRYFWTMWPDIKGEVIVLFGTSKK-NH2 | 3070 |
| JBT0185 | 45487 | G | Ac-KKFWTMWPDIKGEVIVLFGTSKK-NH2 | 3057 |
| JBT0186 | >50000 | | Ac-KKSGVWQTHPRYFWTMWPDIKGKK-NH2 | 3071 |
| JBT0187 | >50000 | | Ac-KKWQTHPRYFWTMWPDIKGEVIKK-NH2 | 3072 |
| JBT0188 | 25532 | G | Ac-KKHPRYFWTMWPDIKGEVIVLFKK-NH2 | 3058 |
| JBT0189 | 35115 | G | Ac-KKYFWTMWPDIKGEVIVLFGTSKK-NH2 | 3059 |
| JBT0190 | 100 | C | Ac-KKSGNTFVDERLLYFLTIGNMGMYAAQLKFRTSKK-NH2 | 3031 |
| JBT0191* | 8935 | F | Ac-MLGVLMRGISALTGDYTARFEFYLNKQTFN-NH2 | 3054 |
| JBT0193 | >50000 | | Ac-KKSGNTFVDERLLYFLTIGNMGMYAAQLKFKK-NH2 | 3073 |
| JBT0194 | >50000 | | Ac-KKSGNTFVDERLLYFLTIGNMGMYAAQKK-NH2 | 3074 |
| JBT0195 | >50000 | | Ac-KKSGNTFVDERLLYFLTIGNMGMYKK-NH2 | 3075 |
| JBT0196 | 3457 | E | Ac-KKSGNTFVDERLLYFLTIGNMKK-NH2 | 3048 |
| JBT0197 | >50000 | | Ac-KKTFVDERLLYFLTIGNMGMYAAQLKFRTSKK-NH2 | 3076 |
| JBT0198 | >50000 | | Ac-KKDERLLYFLTIGNMGMYAAQLKFRTSKK-NH2 | 3077 |
| JBT0199 | >50000 | | Ac-KKLLYFLTIGNMGMYAAQLKFRTSKK-NH2 | 3078 |
| JBT0200 | >50000 | | Ac-KKFLTIGNMGMYAAQLKFRTSKK-NH2 | 3079 |
| JBT0201 | >50000 | | Ac-KKLLYFLTIGNMGMYAAQLKFRKK-NH2 | 3080 |
| JBT0202 | >50000 | | Ac-KKLYFLTIGNMGMYAAQLKFRTKK-NH2 | 3081 |
| JBT0203 | >50000 | | Ac-KKYFLTIGNMGMYAAQLKFRTSKK-NH2 | 3082 |

FIG. 38B

| Object ID | IC50 Mean (nM) | Affinity Class | Sequence | SEQ ID NO: |
|---|---|---|---|---|
| JBT0204 | 25693 | G | Ac-KKSGNTFVDERLLYFLTIGNMGKK-NH2 | 3060 |
| JBT0205 | 72 | B | Ac-KKSGRGCTKVIVFTFRHNKLIGYERRYNCTSKK-NH2 | 3029 |
| JBT0206* | 3594 | E | Ac-TNYTGSEKCIRFVTRRYLGVRINCFHKGS-NH2 | 3049 |
| JBT0207* | 4316 | E | Ac-TRNVVRRYECFGSTGCIKYFIHSRTGLNK-NH2 | 3050 |
| JBT0208 | ND | | Ac-KKSGRGCTKVIVFTFRHNKLIGYERRYNKK-NH2 | 3027 |
| JBT0209 | 4756 | E | Ac-KKSGRGCTKVIVFTFRHNKLIGYERKK-NH2 | 3051 |
| JBT0210 | 20471 | G | Ac-KKSGRGCTKVIVFTFRHNKLIGKK-NH2 | 3061 |
| JBT0211 | 211 | C | Ac-KKGCTKVIVFTFRHNKLIGYERRYNCTSKK-NH2 | 3032 |
| JBT0212 | 117 | C | Ac-KKKVIVFTFRHNKLIGYERRYNCTSKK-NH2 | 3033 |
| JBT0213 | >50000 | | Ac-KKVFTFRHNKLIGYERRYNCTSKK-NH2 | 3083 |
| JBT0214 | 2277 | E | Ac-KKGRGCTKVIVFTFRHNKLIGYKK-NH2 | 3052 |
| JBT0215 | 6146 | F | Ac-KKGCTKVIVFTFRHNKLIGYERKK-NH2 | 3055 |
| JBT0216 | 2123 | E | Ac-KKCTKVIVFTFRHNKLIGYERRKK-NH2 | 3053 |
| JBT0217 | 47024 | G | Ac-KKTKVIVFTFRHNKLIGYERRYKK-NH2 | 3062 |
| JBT0218 | 32865 | G | Ac-KKVIVFTFRHNKLIGYERRYNCKK-NH2 | 3063 |
| JBT0219 | 78 | B | Ac-KKVIVFTFRHNKLIGYERRYNCKK-NH2 | 3030 |
| JBT0220 | 31914 | G | Ac-KKIVFTFRHNKLIGYERRYNCTKK-NH2 | 3064 |
| JBT0344 | 629 | D | Ac-TFVDERLLYFLTIGNMGMYAAQLKF-NH2 | 3038 |
| JBT0345 | 271 | D | Ac-FVDERLLYFLTIGNMGMYAAQLKF-NH2 | 3039 |
| JBT0346 | 214 | C | Ac-VDERLLYFLTIGNMGMYAAQLKF-NH2 | 3034 |
| JBT0347 | 434 | D | Ac-TFVDERLLYFLTIGNMGMYAAQLK-NH2 | 3040 |
| JBT0348 | >5000 | | Ac-TFVDERLLYFLTIGNMGMYAAQ-NH2 | 3084 |
| JBT0349 | 552 | D | Ac-GCTKVIVFTFRHNKLIGYERRYNCTS-NH2 | 3041 |
| JBT0350 | 527 | D | Ac-CTKVIVFTFRHNKLIGYERRYNCTS-NH2 | 3042 |
| JBT0351 | 948 | D | Ac-TKVIVFTFRHNKLIGYERRYNCTS-NH2 | 3043 |
| JBT0352 | 848 | D | Ac-GCTKVIVFTFRHNKLIGYERRYNCT-NH2 | 3044 |
| JBT0353 | 668 | D | Ac-GCTKVIVFTFRHNKLIGYERRYNC-NH2 | 3045 |
| JBT0357 | 125 | C | Ac-KKGVWQTHPRYFWTMWPDIKGEVILFGKK-NH2 | 3035 |
| JBT0358 | 802 | D | Ac-KKGVWQTHPRYFWTMWPDIKGEVILFKK-NH2 | 3046 |

FIGURE 39

| Object ID | EC50 [nM] | Object Name | SEQ ID NO: |
|---|---|---|---|
| JBT0052 | 2.8 | Biotinyl-Ttds-KKSGVWQTHPRYFWTMWPDIKGEVIVLFGTSKK-NH2 | 3004 |
| JBT0053 | 50.3 | Biotinyl-Ttds-SGNTFVDERLLYFLTIGNMGMYAAQLKFRTS-NH2 | 3006 |
| JBT0054 | 2.1 | Biotinyl-Ttds-SGRGCTKVIVFTFRHNKLIGYERRYNCTS-NH2 | 3002 |
| JBT0057 | >5000 | Ac-SGNTFVDERLLYFLTIGNMGMYAAQLKFRTS-Ttds-Lysin(biotin)-NH2 | 3018 |
| JBT0058 | 2.4 | Ac-SGRGCTKVIVFTFRHNKLIGYERRYNCTS-Ttds-Lysin(biotin)-NH2 | 3003 |
| JBT0103 | 4.8 | Ac-KKSGVWQTHPRYFWTMWPDIKGEVIVLFGTS-Ttds-KK-Lysin(biotin)-NH2 | 3005 |
| JBT0105 | >10000 | Biotinyl-Ttds-SGQFWHGLLLPKGIVLNWTLKPWWMIGAFTS-NH2 | 3015 |
| JBT0106 | >10000 | Ac-SGQFWHGLLLPKGIVLNWTLKPWWMIGAFTS-Ttds-Lysin(biotin)-NH2 | 3016 |
| JBT0113 | 458.7 | Biotinyl-Ttds-LSLVGSFAVLCA-NH2 | 3007 |
| JBT0117 | >50000 | Biotinyl-Ttds-SGRFTTRLWYFSWDRLPWYMPFKQYVLSSTS-NH2 | 3019 |
| JBT0118 | >50000 | Biotinyl-Ttds-SGSYQWWARPYRMWFGLPYWNQRVIFPWNTS-NH2 | 3020 |
| JBT0128 | >5000 | Ac-Ttds-SGRVSYYWGVKWSQQMPMSWWPDTWYTFDTS-NH2 | 3017 |
| JBT0130 | 1.2 | Biotinyl-Ttds-SGRG[CTKVIVFTFRHNKLIGYERRYNC]TS-NH2 | 3001 |
| JBT0135 | >50000 | Biotinyl-Ttds-LLYFLTIGNMGMYAAQLKFR-NH2 | 3021 |
| JBT0136 | 16461.9 | Biotinyl-Ttds-LYFLTIGNMGMYAAQLKFRT-NH2 | 3014 |
| JBT0137 | 4120.3 | Biotinyl-Ttds-YFLTIGNMGMYAAQLKFRTS-NH2 | 3013 |
| JBT0138 | 2354.6 | Biotinyl-Ttds-YFLTIGNMGMYAAQLKFR-NH2 | 3012 |
| JBT0139 | 755.5 | Biotinyl-Ttds-GRGCTKVIVFTFRHNKLIGY-NH2 | 3008 |
| JBT0140 | 924.0 | Biotin-Ttds-GCTKVIVFTFRHNKLIGYER-NH2 | 3010 |
| JBT0141 | 800.3 | Biotin-Ttds-CTKVIVFTFRHNKLIGYERR-NH2 | 3009 |
| JBT0142 | >50000 | Biotinyl-Ttds-TKVIVFTFRHNKLIGYERRY-NH2 | 3022 |
| JBT0143 | 4229.9 | Biotinyl-Ttds-KVIVFTFRHNKLIGYERRYN-NH2 | 3023 |
| JBT0144 | 1327.0 | Biotin-Ttds-VIVFTFRHNKLIGYERRYNC-NH2 | 3011 |
| JBT0145 | 650.9 | Biotin-Ttds-VIVFTFRHNKLIGYER-NH2 | 3024 |

|  | C | CA | CB | H | N |
|---|---|---|---|---|---|
| S1 | 174.9 | 58.60 | - | - | - |
| G2 | 173.8 | 45.18 | - | 8.447 | 110.7 |
| Y3 | 175.6 | 57.86 | 38.68 | 8.116 | 120.3 |
| A4iso | 177.0 | 52.26 | - | 8.307 | 126.1 |
| A4 | 177.1 | 52.36 | - | 8.282 | 125.9 |
| S5 | 173.6 | 58.07 | 63.54 | 8.091 | 115.0 |
| S5iso | - | 58.16 | - | 8.151 | 115.3 |
| F6 | - | 55.75 | 38.85 | 8.220 | 122.8 |
| F6iso | - | - | - | 8.146 | 122.6 |
| P7 | 176.8 | 63.24 | - | - | - |
| P7iso | 175.9 | 62.53 | - | - | - |
| L8iso | 177.3 | 55.43 | - | 8.467 | 123.1 |
| L8 | 177.4 | 55.31 | 42.28 | 8.354 | 122.4 |
| A9iso | 177.6 | 52.34 | - | 8.406 | 125.4 |
| A9 | 178.0 | 52.74 | 19.15 | 8.350 | 124.8 |
| V10 | 176.3 | 62.62 | 32.70 | 8.082 | 119.5 |
| V10iso | 176.1 | 62.34 | - | 8.149 | 120.0 |
| Q11iso | 175.7 | 55.52 | - | 8.511 | 124.6 |
| Q11 | 176.0 | 55.88 | 29.17 | 8.453 | 124.0 |
| L12 | 177.2 | 55.48 | 42.23 | 8.372 | 123.6 |
| L12iso | - | - | - | 8.370 | 124.2 |
| H13 | 175.5 | 56.53 | 30.30 | 8.381 | 120.7 |
| V14 | 176.3 | 62.74 | 32.70 | 8.142 | 122.4 |
| S15 | 174.9 | 58.71 | - | 8.570 | 119.8 |
| K16 | 177.2 | 57.38 | - | 8.531 | 123.8 |
| R17 | 177.1 | 56.86 | - | 8.351 | 121.2 |
| S18 | 175.7 | 59.62 | - | 8.330 | 117.1 |
| K19 | 177.7 | 57.91 | - | 8.435 | 123.5 |
| E20 | 178.0 | 57.92 | 29.74 | 8.404 | 120.6 |
| M21 | 177.0 | 56.54 | 32.63 | 8.333 | 120.7 |
| A22 | 178.9 | 53.59 | 18.57 | 8.164 | 123.9 |
| L23 | 177.9 | 55.94 | 42.12 | 8.053 | 120.3 |
| A24 | 178.3 | 53.27 | 18.79 | 8.048 | 123.2 |
| R25 | 176.5 | 56.61 | 30.39 | 8.008 | 118.6 |
| L26 | 177.1 | 55.50 | 42.17 | 7.946 | 121.8 |
| Y27 | 175.3 | 57.84 | 38.73 | 8.010 | 119.5 |
| Y28 | 175.1 | 57.66 | 38.75 | 7.940 | 121.5 |
| K29 | 176.3 | 56.17 | 33.20 | 8.187 | 123.6 |
| T30 | 173.9 | 61.74 | 69.80 | 8.316 | 115.8 |
| S31 | - | 59.99 | 64.51 | 8.012 | 123.2 |

FIGURE 47

|     | C     | CA    | H     | N     |
| --- | ----- | ----- | ----- | ----- |
| S1  | -     | 61.76 | -     | -     |
| G2  | -     | 45.19 | 7.867 | 109.6 |
| Y3  | 178.1 | 56.77 | 7.856 | 123.6 |
| A4  | 179.0 | 53.67 | 8.101 | 121.9 |
| S5  | 176.2 | 56.58 | 7.895 | 119.9 |
| F6  | -     | -     | -     | -     |
| P7  | 173.7 | 63.32 | -     | -     |
| L8  | 176.6 | 60.00 | 8.143 | 122.0 |
| A9  | 181.2 | 55.75 | 7.938 | 118.1 |
| V10 | 177.0 | 66.76 | 7.675 | 115.9 |
| Q11 | 179.4 | 59.70 | 7.519 | 118.6 |
| L12 | 179.6 | 57.91 | 8.864 | 119.6 |
| H13 | 176.3 | 60.46 | 7.684 | 120.4 |
| V14 | 179.8 | 65.76 | 8.178 | 117.4 |
| S15 | 176.3 | 61.89 | 8.102 | 116.0 |
| K16 | 179.7 | 59.89 | 7.930 | 121.8 |
| R17 | 178.7 | 56.68 | 8.718 | 120.2 |
| S18 | 177.0 | 62.62 | 8.340 | 115.0 |
| K19 | 178.3 | 59.41 | 7.388 | 122.2 |
| E20 | 179.0 | 59.18 | 7.566 | 119.5 |
| M21 | 176.7 | 58.97 | 8.277 | 116.8 |
| A22 | 178.1 | 53.69 | 7.445 | 120.4 |
| L23 | 176.6 | 57.07 | 7.745 | 117.1 |
| A24 | 177.3 | 55.82 | 7.793 | 119.6 |
| R25 | 175.5 | 58.20 | 7.787 | 118.5 |
| L26 | 175.0 | 57.73 | 7.868 | 119.7 |
| Y27 | -     | 56.29 | 8.038 | 122.4 |
| Y28 | 178.1 | -     | 8.161 | 72.13 |
| K29 | -     | -     | 8.897 | 118.2 |
| T30 | 173.8 | 61.71 | -     | -     |
| S31 | -     | 60.02 | 7.879 | 122.7 |

FIGURE 49

|     | CA    | CB    | H     | N     |
|-----|-------|-------|-------|-------|
| S-1 | 56,24 | 63,73 | -     | -     |
| F1  | 58,27 | 39,61 | 8,569 | 122,7 |
| Q2  | 55,71 | 29,50 | 8,381 | 123,1 |
| S3  | 58,48 | 63,67 | 8,391 | 117,9 |
| K4  | 56,41 | 33,00 | 8,481 | 123,6 |
| K5  | 56,44 | 33,04 | 8,371 | 122,5 |
| N6  | 53,26 | 38,80 | 8,539 | 120,4 |
| V7  | 62,31 | 32,71 | 8,005 | 119,9 |
| F8  | 57,66 | 39,60 | 8,395 | 124,1 |
| V9  | 62,13 | 33,05 | 8,099 | 122,2 |
| D10 | 55,06 | 41,21 | 8,479 | 124,1 |
| G11 | 45,73 | -     | 8,495 | 110,2 |
| Y12 | 59,71 | 38,88 | 8,110 | 121,0 |
| F13 | 59,22 | 39,25 | 8,170 | 120,3 |
| E14 | 57,68 | 29,76 | 8,343 | 121,8 |
| R15 | 57,05 | 30,44 | 8,130 | 121,0 |
| L16 | 55,81 | 42,18 | 8,049 | 121,9 |
| R17 | 56,35 | 30,54 | 8,121 | 121,1 |
| A18 | 52,68 | 19,41 | 8,144 | 124,6 |
| K19 | 56,27 | 32,87 | 8,237 | 121,0 |
| L20 | 56,70 | 43,25 | 7,956 | 129,8 |

FIGURE 51

|  | C | CA | H | N |
|---|---|---|---|---|
| F1 | 174.5 | 57.69 | 8.559 | 122.1 |
| Q2 | 176.5 | 56.60 | 8.079 | 116.3 |
| S3 | 174.2 | 58.06 | 8.690 | 120.0 |
| K4 | 177.5 | 58.13 | 8.519 | 122.3 |
| K5 | 176.2 | 57.27 | 7.942 | 116.6 |
| N6 | 174.1 | 53.48 | 8.008 | 119.2 |
| V7 | 173.4 | 62.72 | 7.775 | 120.7 |
| F8 | 177.0 | 56.11 | 7.712 | 117.9 |
| V9 | 176.0 | 62.14 | 8.056 | 115.2 |
| D10 | - | 56.04 | 8.619 | 123.6 |
| G11 | 174.2 | - | 8.496 | 110.2 |
| Y12 | 177.3 | 62.74 | 8.444 | 119.2 |
| F13 | 178.2 | 62.61 | 8.342 | 116.9 |
| E14 | 179.9 | 60.23 | 8.326 | 122.0 |
| R15 | 179.4 | 60.05 | 8.205 | 119.5 |
| L16 | 178.8 | 57.88 | 7.770 | 122.5 |
| R17 | 178.1 | 58.84 | 7.782 | 117.5 |
| A18 | 178.0 | 74.53 | 7.161 | 118.7 |
| K19 | 175.6 | 57.01 | 7.722 | 117.7 |
| L20 | - | 56.67 | 7.195 | 126.2 |

FIGURE 53

| | CT (s) | CFT (s) | MCF (mm) | Activity (%) |
|---|---|---|---|---|
| Hem A blood | 2907 | 1540 | - | 0 |
| +4.4nM JBT2317 | 2901 | 2488 | - | 0 |
| +13.3nM JBT2317 | 2249 | 1480 | - | 44 |
| +40nM JBT2317 | 1143 | 457 | 64 | 119 |
| +120nM JBT2317 | 853 | 219 | 64 | 139 |
| Normal blood | 1427 | 312 | 56 | 100 |

| | CT (s) | CFT (s) | MCF (mm) | Activity (%) |
|---|---|---|---|---|
| Hem A blood | 3168 | 1672 | - | 0 |
| +4.4nM JBT2329 | 2296 | 1159 | 63.5 | 52 |
| +13.3nM JBT2329 | 1267 | 421 | 63.5 | 114 |
| +40nM JBT2329 | 930 | 238 | 63.5 | 134 |
| +120nM JBT2329 | 674 | 154 | 63.5 | 150 |
| Normal blood | 1502 | 266 | 55 | 100 |

FIG. 62A

| Compound ID | Sequence | IC50 ELISA IC50 [nM] | Progression curve EC50 (µM) | Progression curve Max. Inh% | SEQ ID NO |
|---|---|---|---|---|---|
| JBT0293 | Ac-FQSKKNVFVFGYFERLRAKL-NH2 | 20353.31 | --- | --- | 4003 |
| JBT0303 | Ac-FQSKKKNVFVDGYFERLRAKL-NH2 | 439.39 | --- | --- | 4004 |
| JBT0375 | Ac-FQSKGNVFVFGYFERLRAKL-NH2 | 440.11 | --- | --- | 4007 |
| JBT0477 | Ac-FQSKGNVFVDGYFERLRAKL-NH2 | 100.73 | --- | --- | 4010 |
| JBT0740 | Ac-FQSKGNVFVDGYFERL-Aib-AKL-NH2 | 34.51 | 0.245 | 94 | 4012 |
| JBT1156 | Ac-FQSKaNVFVDGYFARL-Nle-AKL-NH2 | 416.11 | --- | --- | 4014 |
| JBT1319 | Ac-YQSKNNVFVDGYFERLCAKL-NH2 | 137.2 | --- | --- | 4015 |
| JBT1320 | Ac-FQSKERVFVDGYFERLCAKL-NH2 | 364.74 | --- | --- | 4016 |
| JBT1584 | Ac-FQSK-Nmg-NVFVDGYFERL-Aib-AKL-NH2 | 5.3 | --- | --- | 4017 |
| JBT1585 | Ac-FQSK-Nmg-NVFVTGYFERL-Aib-AKL-NH2 | 15.14 | --- | --- | 4018 |
| JBT1855 | Ac-FQSKGNVFVDGYFERL-Aib-AKLC(PEG)-NH2 | 121.04 | --- | --- | 4019 |
| JBT1857 | Ac-FQSKpNVHVDGYFERL-Aib-AKL-NH2 | 3 | 0.0037 | 90 | 4020 |
| JBT2258 | Ac-FQSKKNVFV-NH2 | --- | --- | --- | 4022 |
| JBT2262 | FAM-Ttds-FQSK-Nmg-NVFVDGYFERL-Aib-AKL-NH2 | 13.4 | --- | --- | 4024 |
| JBT2270 | Ac-PEFQSK-Nmg-NVFVDGYFERL-Aib-AKL-NH2 | 1.94 | --- | --- | 4032 |
| JBT2274 | Ac-FQSK-NpropylG-NVHVDGYFERL-Aib-AKL-NH2 | 4.34 | --- | --- | 4036 |
| JBT2275 | Ac-FQSK-aze-NVHVDGYFERL-Aib-AKL-NH2 | 2.74 | --- | --- | 4037 |
| JBT2276 | Ac-FQSK-pip-NVHVDGYFERL-Aib-AKL-NH2 | 3.27 | --- | --- | 4038 |
| JBT2277 | Ac-FQSK-tic-NVHVDGYFERL-Aib-AKL-NH2 | 3.86 | --- | --- | 4039 |
| JBT2278 | Ac-FQSK-oic-NVHVDGYFERL-Aib-AKL-NH2 | 2.27 | --- | --- | 4040 |
| JBT2279 | Ac-FQSK-hyp-NVHVDGYFERL-Aib-AKL-NH2 | 2.72 | --- | --- | 4041 |
| JBT2280 | Ac-FQSK-nma-NVHVDGYFERL-Aib-AKL-NH2 | 4.6 | --- | --- | 4042 |
| JBT2281 | Ac-FQSK-Ncg-NVHVDGYFERL-Aib-AKL-NH2 | 6.08 | --- | --- | 4043 |
| JBT2282 | Ac-FQSK-Abg-NVHVDGYFERL-Aib-AKL-NH2 | 9.98 | --- | --- | 4044 |
| JBT2283 | Ac-FQSK-Apg-NVHVDGYFERL-Aib-AKL-NH2 | 20.12 | --- | --- | 4045 |
| JBT2284 | Ac-FQSK-thz-NVHVDGYFERL-Aib-AKL-NH2 | 671.59 | --- | --- | 4046 |
| JBT2285 | Ac-FQSK-dtc-NVHVDGYFERL-Aib-AKL-NH2 | 3.44 | --- | --- | 4047 |
| JBT2287 | Ac-FQSKp-Nmn-VHVDGYFERL-Aib-AKL-NH2 |  | --- | --- | 4049 |
| JBT2288 | Ac-FQSKp-Nma-VHVDGYFERL-Aib-AKL-NH2 |  | --- | --- | 4050 |
| JBT2289 | Ac-FQSKp-Nmk-VHVDGYFERL-Aib-AKL-NH2 |  | --- | --- | 4051 |
| JBT2290 | Ac-FQSKp-Nmr-VHVDGYFERL-Aib-AKL-NH1 |  | --- | --- | 4052 |
| JBT2291 | Ac-FQSKp-Nms-VHVDGYFERL-Aib-AKL-NH2 | 644.27 | --- | --- | 4053 |
| JBT2292 | Ac-FQSKpnVHVDGYFERL-Aib-AKL-NH2 | 1124.91 | --- | --- | 4054 |
| JBT2293 | Ac-FQSKpN-Chg-HVDGYFERL-Aib-AKL-NH2 | 45.13 | --- | --- | 4055 |
| JBT2294 | Ac-FQSKpNVH-Chg-DGYFERL-Aib-AKL-NH2 | 332.48 | --- | --- | 4056 |

FIG. 62B

| Compound ID | Sequence | IC50 ELISA IC50 [nM] | Progression curve EC50 (μM) | Progression curve Max. Inh% | SEQ ID NO |
|---|---|---|---|---|---|
| JBT2295 | Ac-FQSKpN-Chg-H-Chg-DGYFERL-Aib-AKL-NH2 | | --- | --- | 4057 |
| JBT2296 | Ac-FQSKpN-Phg-H-Phg-HVDGYFERL-Aib-AKL-NH2 | 639.17 | --- | --- | 4058 |
| JBT2297 | Ac-FQSKpNVH-Phg-DGYFERL-Aib-AKL-NH2 | 66.94 | --- | --- | 4059 |
| JBT2298 | Ac-FQSKpN-Phg-H-Phg-DGYFERL-Aib-AKL-NH2 | | --- | --- | 4060 |
| JBT2299 | Ac-FQSKpNVHVDGYFERL-Deg-AKL-NH2 | 3.01 | --- | --- | 4061 |
| JBT2300 | Ac-FQSKpNVHVDGYFERL-Ebc-AKL-NH2 | 8.39 | --- | --- | 4062 |
| JBT2301 | Ac-FQSKpNVHVDGYFERL-Eca-AKL-NH2 | 3.36 | --- | --- | 4063 |
| JBT2302 | Ac-FQSKpNVHVDGYFERL-Egz-AKL-NH2 | 2.7 | --- | --- | 4064 |
| JBT2303 | Ac-FQSKpNVHVDGYFERL-Aic-AKL-NH2 | 3.04 | --- | --- | 4065 |
| JBT2304 | Ac-FQSKpNVHVDGYFERL-Apc-AKL-NH2 | 2.22 | --- | --- | 4066 |
| JBT2305 | Ac-FQSKpNVHVDGYFERL-Egt-AKL-NH2 | 4.48 | --- | --- | 4067 |
| JBT2306 | Ac-1Ni-QSKpNVHVDGYFERL-Aib-AKL-NH2 | 3.13 | --- | --- | 4068 |
| JBT2307 | Ac-Thi-QSKpNVHVDGYFERL-Aib-AKL-NH2 | 3.41 | --- | --- | 4069 |
| JBT2308 | Ac-Bta-QSKpNVHVDGYFERL-Aib-AKL-NH2 | 3.04 | --- | --- | 4070 |
| JBT2309 | Ac-FQSKpNVHVDGY-1Ni-ERL-Aib-AKL-NH2 | 1.63 | --- | --- | 4071 |
| JBT2310 | Ac-FQSKpNVHVDGY-Thi-ERL-Aib-AKL-NH2 | 3.81 | --- | --- | 4072 |
| JBT2311 | Ac-FQSKpNVHVDGY-Bta-ERL-Aib-AKL-NH2 | 1.94 | --- | --- | 4073 |
| JBT2312 | Ac-FQSKpNVHVDG-Tym-FERL-Aib-AKL-NH2 | 194.26 | --- | --- | 4074 |
| JBT2313 | Ac-FQSKpNVHVDG-Pty-FERL-Aib-AKL-NH2 | 257.97 | --- | --- | 4075 |
| JBT2314 | Ac-FQSKpNVHVDG-Pmy-FERL-Aib-AKL-NH2 | 5.14 | --- | --- | 4076 |
| JBT2315 | Ac-FQSKpNVHVDGYFERL-Aib-AKLC-NH2 | 2.49 | --- | --- | 4077 |
| JBT2317 | Ac-FQSKpNVHVDGYFERL-Aib-AKLC(NEM)-NH2 | 2.91 | 0.0038 | 89 | 4078 |
| JBT2325 | Ac-FQSKpNVHVDGYFERL-Aib-AKLC(PEG)-NH2 | 6.6 | --- | --- | 4086 |
| JBT2326 | Ac-FQSKpNVHVDGYFERL-Aib-AKLC(PEG)-NH2 | 9.3 | --- | --- | 4087 |
| JBT2327 | Ac-FQSKpNVHVDGYFERL-Aib-AKLC(PEG)-NH2 | 10.92 | --- | --- | 4088 |
| JBT2328 | Ac-FQSKpNVHVDGYFERL-Aib-AKLC(PEG)-NH2 | 12.29 | --- | --- | 4089 |
| JBT2329 | Ac-FQSKpNVHVDGYFERL-Aib-AKLC(ME-400MA)-NH2 | 12.62 | 0.0060 | 93 | 4090 |
| JBT2366 | Ac-Bta-QSKpNVHVDGY-1Ni-ERL-Aib-AKL-NH2 | 1.99 | 0.0033 | 83 | 4091 |
| JBT2367 | Ac-Bta-QSKpNVHVDGY-Bta-ERL-Aib-AKL-NH2 | 2.05 | 0.0026 | 81 | 4092 |
| JBT2368 | Ac-1Ni-QSKpNVHVDGY-1Ni-ERL-Aib-AKL-NH2 | 2.32 | 0.0032 | 78 | 4093 |
| JBT2369 | Ac-1Ni-QSKpNVHVDGY-Bta-ERL-Aib-AKL-NH2 | 2.03 | 0.0023 | 81 | 4094 |
| JBT2370 | Ac-FQSKpCVHVDGYFERL-Aib-AKL-NH2 | 6.33 | --- | --- | 4238 |
| JBT2371 | Ac-FQSKpNVHVCGYFERL-Aib-AKL-NH2 | 10.67 | --- | --- | 4095 |
| JBT2372 | Ac-FQSKpNVHVDGYCERL-Aib-AKL-NH2 | 11.68 | --- | --- | 4096 |
| JBT2373 | Ac-FQSKpNVHVDGYFCRL-Aib-AKL-NH2 | 4.07 | --- | --- | 4097 |

FIG. 62C

| Compound ID | Sequence | IC50 ELISA IC50 [nM] | Progression curve EC50 (μM) | Progression curve Max. Inh% | SEQ ID NO |
|---|---|---|---|---|---|
| JBT2381 | Ac-FQSKpNVH-Abu-DGYFERL-Aib-AKLC(NEM)-NH2 | 3.45 | n.a. | --- | 4100 |
| JBT2382 | Ac-FQSKpNVH-(L-2-Amino-4,4,4-trifluorobutyric acid)-DGYFERL-Aib-AKLC(NEM)-NH2 | 62.74 | n.a. | --- | 4101 |
| JBT2383 | Ac-FQSKpNVH-Cpg-DGYFERL-Aib-AKLC(NEM)-NH2 | 52.18 | n.a. | --- | 4102 |
| JBT2384 | Ac-FQSKpNVHvDGYFERL-Aib-AKLC(NEM)-NH2 | 24.23 | n.a. | --- | 4103 |
| JBT2385 | Ac-FQSKpNVH-Aib-DGYFERL-Aib-AKLC(NEM)-NH2 | 4.23 | 0.0052 | 94 | 4104 |
| JBT2386 | Ac-FQSKpNVH-Tle-DGYFERL-Aib-AKLC(NEM)-NH2 | | n.a. | | 4105 |
| JBT2387 | Ac-FQSKpNVH-Nmv-DGYFERL-Aib-AKLC(NEM)-NH2 | 9.62 | n.a. | --- | 4106 |
| JBT2388 | Ac-FQSKpNVHV-Nmd-GYFERL-Aib-AKLC(NEM)-NH2 | 4.4 | n.a. | --- | 4107 |
| JBT2389 | Ac-FQSKpNVVHGYFERL-Aib-AKLC(NEM)-NH2 | 2.97 | n.a. | --- | 4108 |
| JBT2390 | Ac-FQSKpNVHVSGYFERL-Aib-AKLC(NEM)-NH2 | 3.05 | n.a. | --- | 4109 |
| JBT2391 | Ac-FQSKpNVHVTGYFERL-Aib-AKLC(NEM)-NH2 | 2.62 | n.a. | --- | 4110 |
| JBT2392 | Ac-FQSKpNVHVPGYFERL-Aib-AKLC(NEM)-NH2 | 32.75 | n.a. | --- | 4111 |
| JBT2393 | Ac-FQSKpNVHVdGYFERL-Aib-AKLC(NEM)-NH2 | 5.53 | n.a. | --- | 4112 |
| JBT2394 | Ac-FQSKpNVH-Tle-PGYFERL-Aib-AKLC(NEM)-NH2 | 4.37 | n.a. | --- | 4113 |
| JBT2395 | Ac-FQSKpNVH-Tle-TGYFERL-Aib-AKLC(NEM)-NH2 | 31.54 | n.a. | --- | 4114 |
| JBT2396 | Ac-FQSKpNVHVDAYFERL-Aib-AKLC(NEM)-NH2 | 2.44 | 0.0015 | 87 | 4115 |
| JBT2397 | Ac-FQSKp-C(NEM)-VHVDGYFERL-Aib-AKL-NH2 | 4.29 | 0.0164 | 93 | 4116 |
| JBT2398 | Ac-FQSKpNVHV-C(NEM)-GYFERL-Aib-AKL-NH2 | 4.23 | 0.0131 | 88 | 4117 |
| JBT2399 | Ac-FQSKpNVHVDGYF-C(NEM)-RL-Aib-AKL-NH2 | | | | 4118 |
| JBT2400 | Ac-FQSKpNVHVDGYFERL-Aib-AKLK(Tds-Maleimidopropionyl(EtSH))-NH2 | 4.02 | 0.0465 | 86 | 4119 |
| JBT2401 | Ac-FQSKpNVHVDGYFERL-Aib-AKLC(Y-MAL-40K)-NH2 | 22.42 | 0.0077 | 91 | 4120 |
| JBT2402 | Ac-FQSKp-C(ME-400MA)-VHVDGYFERL-Aib-AKL-NH2 | 20.46 | 0.0026 | 82 | 4121 |
| JBT2403 | Ac-FQSKpNVHV-C(ME-400MA)-GYFERL-Aib-AKL-NH2 | 22.89 | 0.0153 | 80 | 4122 |
| JBT2404 | Ac-FQSKpNVHVDGYF-C(ME-400MA)-RL-Aib-AKL-NH2 | 18.18 | 0.0134 | 86 | 4123 |
| JBT2405 | [FQSkpNVHVDGYFERL-Aib-AKL-FA19205] | 38.76 | --- | | 4124 |
| JBT2406 | [FQSkpNVHVDGYFERL-Aib-AKL-FA19204] | 75.35 | --- | | 4125 |
| JBT2407 | [FQSkpNVHVDGYFERL-Aib-AKL-FA19203] | 28.48 | --- | | 4126 |
| JBT2408 | [FQSkpNVHVDGYFERL-Aib-AKL-FA03202] | 65.52 | --- | | 4127 |
| JBT2410 | Ac-FQSkpNVHVDGYFERL-Aib-AKLK(Ttds-Maleimid-HSA)-NH2 | 5.09 | 0.0047 | 87 | 4129 |
| JBT2411 | Ac-FQSKp-Tle-DGYFERL-Aib-AKL-NH2 | 4.61 | 0.0035 | 90 | 4130 |
| JBT2412 | Ac-FQSKp-Cit-VH-Tle-DGYFERL-Aib-AKL-NH2 | 6.09 | 0.0085 | 90 | 4131 |
| JBT2413 | Ac-FQSKpvVH-Tle-DGYFERL-Aib-AKL-NH2 | 8.6 | 0.0224 | 90 | 4132 |
| JBT2414 | Ac-FQSKpNVH-Tle-DaYFERL-Aib-AKLC-NH2 | 5.99 | 0.0130 | 88 | 4133 |

FIG. 62D

| Compound ID | Sequence | IC50 ELISA IC50 [nM] | Progression curve EC50 (µM) | Progression curve Max. Inh% | SEQ ID NO |
|---|---|---|---|---|---|
| JBT2415 | Ac-FQSKp-C(Acm)-VH-Tle-DGYFERL-Aib-AKL-NH2 | 3.78 | 0.0046 | 89 | 4134 |
| JBT2416 | Ac-FQSKp-Nle-VH-Tle-DGYFERL-Aib-AKL-NH2 | 7.72 | 0.0164 | 85 | 4135 |
| JBT2418 | Ac-FQSKpRVH-Tle-DGYFERL-Aib-AKL-NH2 | 3.12 | 0.0049 | 89 | 4136 |
| JBT2419 | Ac-FQSKpSVH-Tle-DGYFERL-Aib-AKL-NH2 | 3.23 | 0.0048 | 89 | 4137 |
| JBT2420 | Ac-FQSKpIVH-Tle-DGYFERL-Aib-AKL-NH2 | 7.33 | 0.0259 | 94 | 4138 |
| JBT2421 | Ac-FQSKpNVH-Tle-D-Sar-YFERL-Aib-AKL-NH2 | 19.51 | n.a. | --- | 4139 |
| JBT2422 | Ac-FQSKpNVH-Tle-DpYFERL-Aib-AKL-NH2 | 28.02 | n.a. | --- | 4140 |
| JBT2423 | Ac-FQSKpNVH-Tle-DGYFERL-Aib-LKL-NH2 | 3.56 | 0.0057 | 89 | 4141 |
| JBT2424 | Ac-FQSKpNVH-Tle-DGYFERL-Aib-Nle-KL-NH2 | 4.37 | 0.0088 | 85 | 4142 |
| JBT2425 | Ac-FQSKpNVH-Tle-DGYFERL-Aib-A-Nmk-L-NH2 |  | n.a. | --- | 4143 |
| JBT2426 | Ac-FQDKpNVH-Tle-DGYFERL-Aib-AKL-NH2 | 10.46 | n.a. | --- | 4144 |
| JBT2427 | Ac-FQEKpNVH-Tle-DGYFERL-Aib-AKL-NH2 | 5.24 | 0.0031 | 85 | 4145 |
| JBT2428 | Ac-FQVH-Tle-DGYFERL-Aib-AKL-NH2 |  | n.a. | --- | 4146 |
| JBT2429 | Ac-FqVH-Tle-DGYFERL-Aib-AKL-NH2 |  | n.a. | --- | 4147 |
| JBT2430 | Ac-FQSKpNVHVDGYFERL-Aib-AKLK(AOA-40kDa PSA)-NH2 | 5.6 | 0.0009 | 86 | 4148 |
| JBT2431 | Ac-FQSKpNVH-Tle-DGYFERL-Aib-AKL-NH2 | 4.74 | 0.0063 | 83 | 4149 |
| JBT2432 | Ac-FQSKpNVHVPGYFERL-Aib-AKL-NH2 | 3.76 | 0.0046 | 80 | 4150 |
| JBT2433 | Ac-FQSKpNVHVPaYFERL-Aib-AKL-NH2 | 5.71 | 0.0178 | 96 | 4151 |
| JBT2434 | Ac-FQSKpNVHVPGYF-Aib-RL-Aib-AKL-NH2 | 5.53 | 0.0106 | 92 | 4152 |
| JBT2435 | Ac-FQSKpNVH-Tle-DaYFERL-Aic-AKL-NH2 | 8 | 0.0125 | 87 | 4153 |
| JBT2436 | Ac-FQSKpNVH-Tle-DaYFERL-Eca-AKL-NH2 | 5.69 | 0.0116 | 91 | 4154 |
| JBT2437 | Ac-FQSKpNVH-Tle-DaYFERL-Deg-AKL-NH2 | 5.69 | 0.0175 | 89 | 4155 |
| JBT2438 | Ac-FQSKpNVH-Tle-DaYFERL-Aib-Aib-KL-NH2 | 8.55 | 0.0214 | 88 | 4156 |
| JBT2439 | Ac-FQSKpNV-2Ni--Tle-DaYFERL-Aib-AKL-NH2 | 8.01 | 0.0059 | 91 | 4157 |
| JBT2440 | Palm-FQSKpNVH-Tle-DaYFERL-Aib-AKL-NH2 |  | n.a. | --- | 4158 |
| JBT2441 | Ac-FQSKpNVH-Tle-DaYFERL[-Hcy-Aib-AK-Hcy-]-NH2 | 55.25 | n.a. | --- | 4159 |
| JBT2442 | Ac-FQSKpNV-1Ni--Tle-DaYFERL-Aib-AKL-NH2 | 15.29 | 0.0270 | 86 | 4239 |
| JBT2443 | Ac-FQCkpCVH-Tle-DaYFERL-Aib-AKL-NH2 | 237.49 | n.a. | --- | 4160 |
| JBT2444 | Ac-FQSKpNVH-Tle-DaYFERL-Hle-Aib-AKL-NH2 | 12.54 | n.a. | --- | 4161 |
| JBT2445 | Ac-FQSKpN-Tle-H-Tle-DaYFERL-Aib-AKL-NH2 | 129.64 | n.a. | --- | 4162 |
| JBT2446 | Ac-FQSKpNVH-Tle-DaYFERL-Aib-A-Har-L-NH2 | 57.48 | n.a. | --- | 4163 |
| JBT2447 | Ac-FQSKpNVH-Tle-DaYFERL-Aib-A-Opc-L-NH2 |  | n.a. | --- | 4164 |
| JBT2448 | Ac-FQSKpNVH-Tle-DaYFERL-Aib-KL-NH2 | 9.36 | n.a. | --- | 4165 |
| JBT2449 | Ac-FQSKpNVH-Tle-DaYFERLa-Aib-KL-NH2 | 43.23 | n.a. | --- | 4166 |
| JBT2450 | Ac-FQSKpNVH-Tle-DaYFl-Hcy-RLA-Hcy-]KL-NH2 | 398.31 | n.a. | --- | 4167 |

FIG. 62L

| Compound ID | Sequence | IC50 ELISA IC50 [nM] | Progression curve EC50 (µM) | Progression curve Max. Inh% | SEQ ID NO |
|---|---|---|---|---|---|
| JBT2451 | Ac-FQSKpEVH-Tle-DaYFERL-Aib-AKL-NH2 | 7.36 | n.a. | --- | 4168 |
| JBT2452 | Ac-FQSKp-Ede(O)-VH-Tle-DaYFERL-Aib-AKL-NH2 | 5.75 | n.a. | --- | 4169 |
| JBT2453 | Ac-FQ-Ede(O)-KpNVH-Tle-DaYFERL-Aib-AKL-NH2 | 7.9 | n.a. | --- | 4170 |
| JBT2458 | 374-FQSKpNVH-Tle-DaYFERL-Aib-AKL-NH2 | 6.17 | 0.0062 | 90 | 4173 |
| JBT2459 | 1281-FQSKpNVH-Tle-DaYFERL-Aib-AKL-NH2 | 8.45 | 0.0096 | 86 | 4174 |
| JBT2460 | 5963-FQSKpNVH-Tle-DaYFERL-Aib-AKL-NH2 | 10.9 | n.a. | --- | 4175 |
| JBT2461 | 1525-FQSKpNVH-Tle-DaYFERL-Aib-AKL-NH2 | 3.74 | 0.0031 | 87 | 4176 |
| JBT2462 | 4635-FQSKpNVH-Tle-DaYFERL-Aib-AKL-NH2 | 6.3 | 0.0093 | 88 | 4177 |
| JBT2463 | 3067-FQSKpNVH-Tle-DaYFERL-Aib-AKL-NH2 | 4.15 | 0.0035 | 86 | 4178 |
| JBT2464 | 972-FQSKpNVH-Tle-DaYFERL-Aib-AKL-NH2 | 7.72 | 0.0043 | 84 | 4179 |
| JBT2465 | 973-FQSKpNVH-Tle-DaYFERL-Aib-AKL-NH2 | 6.41 | 0.0027 | 82 | 4180 |
| JBT2466 | Ac-FQSKpNVH-Tle-DaYFERL-Aib-[CKL-Cea-] | 8.27 | 0.0212 | 71 | 4181 |
| JBT2467 | Ac-FQSKpNVH-Tle-DaYFERL-Aib-[cKL-Cea-] | 6.4 | 0.0173 | 60 | 4182 |
| JBT2468 | Ac-FQSKpNVH-Tle-DaYFERL[CAKL-Cea] | 60.46 | n.a. | --- | 4183 |
| JBT2469 | Ac-FQSKpNVH-Tle-DaYFERL[cAKL-Cea-] | 14.71 | 0.0187 | 73 | 4184 |
| JBT2470 | Ac-FQSKpNVH-Tle-DaYFER-Aib-Ak-Aml--NH2 | 19.61 | n.a. | --- | 4185 |
| JBT2471 | Ac-FQSKpNVH-Tle-DaYFER-Aml-AAKL-NH2 | 9.34 | 0.0222 | 85 | 4186 |
| JBT2472 | Ac-FQSKpNVH-Tle-DaYFERL-Aib-LKL-NH2 | 7.59 | 0.0201 | 87 | 4187 |
| JBT2473 | Ac-FQSKpNVH-Tle-DaYF-Aib-RL-Aib-LKL-NH2 | 11.92 | 0.0621 | 83 | 4188 |
| JBT2474 | Ac-FQSKpNVH-Tle-DaYF-Aib-RL-Aib-AKL-NH2 | 7.27 | 0.0383 | 85 | 4189 |
| JBT2475 | Ac-FQSKpNVHVPaYF-Aib-RL-Aib-AKL-NH2 | 7.66 | 0.0350 | 86 | 4190 |
| JBT2476 | Ac-FQSKpNVHVPaYFERL-Aib-LKL-NH2 | 5.17 | 0.0169 | 81 | 4191 |
| JBT2477 | Ac-FQSKpNVHVPaYF-Aib-RL-Aib-LKL-NH2 | 13.85 | n.a. | --- | 4192 |
| JBT2478 | Ac-FQSKpNVH-Tle-Da-Dopa-FERL-Aib-AKL-NH2 | 38.36 | n.a. | --- | 4193 |
| JBT2479 | Ac-YQSKpNVH-Tle-DaYFERL-Aib-AKL-NH2 | 4.41 | 0.0092 | 81 | 4194 |
| JBT2480 | Ac--Dopa-QSKpNVH-Tle-DaYFERL-Aib-AKL-NH2 | 6.33 | n.a. | --- | 4195 |
| JBT2485 | Ac-FQSKpNV-Pmy-Tle-DaYFERL-Aib-AKL-NH2 | 5.55 | 0.0084 | 92 | 4200 |
| JBT2486 | Ac-FQSKpNTH-Tle-DaYFERL-Aib-AKL-NH2 | 8.11 | 0.0358 | 87 | 4201 |
| JBT2487 | Ac-FQSKp-Cmc-VH-Tle-DaYFERL-Aib-AKL-NH2 | 9.1 | 0.0150 | 88 | 4202 |
| JBT2488 | Ac-FQ-Cmc-KpNVH-Tle-DaYFERL-Aib-AKL-NH2 | 9.04 | 0.0173 | 87 | 4203 |
| JBT2489 | Ac-FQSKpNVH-Tle-DaYF[-Hcy-RL-Aib-Hcy-]KL-NH2 | | n.a. | --- | 4204 |
| JBT2490 | Ac-FQSKpNVH-Tle-DaYF[cRLA-Hcy-]KL-NH2 | 6165.16 | n.a. | --- | 4205 |
| JBT2491 | Ac-FQSKpNVH-Tle-DaYF[CRLA-Hcy-]KL-NH2 | | n.a. | --- | 4206 |
| JBT2492 | Ac-FQSKpNVH-Tle-DaYF[cRLC]AKL-NH2 | | n.a. | --- | 4207 |
| JBT2493 | Ac-FQSKpNVH-Tle-DaYF[CRLC]AKL-NH2 | | n.a. | --- | 4208 |

FIG. 62F

| Compound ID | Sequence | IC50 ELISA IC50 [nM] | Progression curve EC50 (µM) | Progression curve Max. Inh% | SEQ ID NO |
|---|---|---|---|---|---|
| JBT2494 | Ac-FQSKpNVH-Tle-D[cYF-Hcy-]RL-Aib-AKL-NH2 | 2.84 | 0.0020 | 88 | 4209 |
| JBT2495 | Ac-FQSKpNVH-Tle-D[cYFC]RL-Aib-AKL-NH2 | 3.48 | 0.0021 | 90 | 4210 |
| JBT2496 | Ac-FQSKpNVHVDGYFERL-Aib-AKLC(Ac-FQSKpNVHVDGYFERL-Aib-AKLK(Tlds-Maleiimidopropionyl)-NH2)--NH2 | 0.75 | | | 4211 |
| JBT2497 | Ac-FQSKpNVH-Tle-D[-hcy-YF-Hcy-]RL-Aib-AKL-NH2 | 7.16 | | | 4212 |
| JBT2498 | Ac-FQSKpNVH-Tle-D[-hcy-YFC]RL-Aib-AKL-NH2 | 7.59 | | | 4213 |
| JBT2499 | Ac-FQSKpNVHVP[cYF-Hcy-]RL-Aib-AKL-NH2 | 3.89 | | | 4214 |
| JBT2500 | Ac-FQSKpNVH-Tle-DcY-Bta--Hcy-RL-Aib-AKL-NH2 | 6.03 | | | 4215 |
| JBT2501 | Ac-FQSKp-C(Acm)-VH-Tle-DcY-Bta--Hcy-RL-Aib-AKL-NH2 | 3.89 | | | 4216 |
| JBT2502 | Ac-FQSKp-C(NEM)-VH-Tle-DaY-Bta-ERL-Aib-AKL-NH2 | 4.1 | | | 4217 |
| JBT2503 | Ac-FQSKp-C(NEM)-VHVPaY-Bta-ERL-Aib-AKL-NH2 | 5.04 | | | 4218 |
| JBT2504 | Ac-FQSKpNVH-Tle-DaYFER-Aml--Aib-AKL-NH2 | 9.43 | | | 4219 |
| JBT2505 | Ac-FQSKp-Ecl-VHVPaYFERL-Aib-AKL-NH2 | 5.82 | | | 4220 |
| JBT2506 | Ac-FQSKp-Eea-VHVPaYFERL-Aib-AKL-NH2 | 6.01 | | | 4221 |
| JBT2507 | Ac-FQSKp-Eec-VHVPaYFERL-Aib-AKL-NH2 | 9.71 | | | 4222 |
| JBT2508 | Ac-FQSKp-Eef-VHVPaYFERL-Aib-AKL-NH2 | 31.05 | | | 4223 |
| JBT2509 | Ac-FQSKp-Nif-VHVPaYFERL-Aib-AKL-NH2 | 19.69 | | | 4224 |
| JBT2510 | Ac-FQSKp-Eew-VHVPaYFERL-Aib-AKL-NH2 | 8.86 | | | 4225 |
| JBT2511 | Ac-FQSKpNVH-Tle-DaY-Bta-ERL-Aib-cKL-Cea- | 189.24 | | | 4226 |
| JBT2512 | Ac-FQSKp-C(Acm)-VH-Tle-DaY-Bta-ERL-Aib-cKL-Cea- | 157.63 | | | 4227 |
| JBT2513 | Ac-FQSKpNVH-Tle-DaYFERL-Aib-[-hcy-KL-Cea-] | 317.99 | | | 4228 |
| JBT2514 | Ac-FQSKpNVH-Tle-DaYFERL-Aib-cKL-Hcy--NH2 | 132.62 | | | 4229 |
| JBT2515 | Ac-FQSKpNVH-Tle-DaYFERL-Aib-[cKLC]-NH2 | 579.9 | | | 4230 |
| JBT2516 | Ac-FQSKpNVH-Tle-DaYFERL-Aib-[cKLc]-NH2 | 472.87 | | | 4231 |
| JBT2517 | Ac-FQSKpNVHVPaY-Bta-ERL-Aib-cKL-Cea- | 269.09 | | | 4232 |
| JBT2518 | Ac-FQSKpNVHVPcY-Bta--Hcy-RL-Aib-AKL-NH2 | 10.78 | | | 4233 |

FIG. 65A

| JBT # | SEQ ID NO | Sequence |
|---|---|---|
| 0292 | 4002 | Ac-KKSGVGRLQVAFQSKKNVFVFGYFERLRAKLTSK-Lys(FAM)-NH2 |
| 2257 | 4021 | Biotinyl-Ttds-QKVRFVLDKEAGSFLYRGFN-NH2 |
| 2261 | 4023 | Biotinyl-Ttds-FQSK-Nmg-NVFVDGYFERL-Aib-AKL-NH2 |
| 2263 | 4025 | Ac-FK-Nmg-VSAEYDVGLL-Aib-KFFQRN-NH2 |
| 2264 | 4026 | Biotin-Ttds-FK-Nmg-VSAEYDVGLL-Aib-KFFQRN-NH2 |
| 2265 | 4027 | FAM-Ttds-FK-Nmg-VSAEYDVGLL-Aib-KFFQRN-NH2 |
| 2266 | 4028 | Ac-PFQSKGNVFVDGYFERLRAKL-NH2 |
| 2267 | 4029 | Ac-PEFQSKGNVFVDGYFERLRAKL-NH2 |
| 2268 | 4030 | Ac-PFQSK-Nmg-NVFVDGYFERL-Aib-AKL-NH2 |
| 2269 | 4031 | Ac-YQTK-Nmg-NVFVDGYFERL-Aib-AKL-NH2 |
| 2271 | 4033 | Biotinyl-Ttds-FQSKpNVHVDGYFERL-Aib-AKL-NH2 |
| 2272 | 4034 | Ac-GKRLKFD-Nmg-YLFNEAVQSF-Aib-V-NH2 |
| 2273 | 4035 | Ac-Nmg-LYFKANF-Aib-SVDQFEVGRLK-NH2 |
| 2286 | 4048 | Ac-FQSkpPVHVDGYFERL-Aib-AKL-NH2 |
| 2318 | 4079 | Ac-FQSkpNVHVDGYFERL-Aib-AKL-Ttds-Lys(biotinyl)-NH2 |
| 2319 | 4080 | Ac-VF-Aib-EVLKFGHALKpNSQDRY-NH2 |
| 2320 | 4081 | Ac-FpDYVER-Aib-KGFLVHQKLASN-NH2 |
| 2321 | 4082 | Biotinyl-Ttds-VF-Aib-EVLKFGHALKpNSQDRY-NH2 |
| 2322 | 4083 | Biotinyl-Ttds-FpDYVER-Aib-KGFLVHQKLASN-NH2 |
| 2323 | 4084 | Ac-VF-Aib-EVLKFGHALKpNSQDRY-Ttds-Lys(biotinyl)-NH2 |
| 2324 | 4085 | Ac-FpDYVER-Aib-KGFLVHQKLASN-Ttds-Lys(biotinyl)-NH2 |
| 2374 | 4098 | Ac-FQSkpNVHVDGYFERL-Aib-AKL-K(Ttds-Maleimidopropionyl)-NH2 |
| 2375 | 4099 | Ac-FQSkpNVHVDGYFERL-Aib-AKLK(Aoa)-NH2 |
| 2409 | 4128 | Ac-FQSkpNVHVDGYFERL-Aib-AKLC(20 kDa PSA)-NH2 |
| 2454 | 4171 | FAM-Ttds-FQSKpNVHVDGYFERL-Aib-AKL-NH2 |
| 2455 | 4172 | FAM-Ttds-VF-Aib-EVLKFGHALKpNSQDRY-NH2 |
| 2481 | 4196 | Ac-FQSKp-C(NEM)-VH-Tle-DaY-Bta-ERL-Aib-AKL-NH2 |
| 2482 | 4197 | Ac-FQSKp-oic-C(NEM)-VH-Tle-DaY-Bta-ERL-Aib-AKL-NH2 |
| 2483 | 4198 | Ac-FQSKp-C(NEM)-VHVPaY-Bta-ERL-Aib-AKL-NH2 |
| 2484 | 4199 | Ac-FQSK-oic-C(NEM)-VHVPaY-Bta-ERL-Aib-AKL-NH2 |
| 0621 | 1294 | Ac-SRYKWF[Dab-GMRDMKGTMS-D]VWVKF-NH2 |
| 0622 | 1295 | Ac-SRYKWF[Orn-GMRDMKGTMS-D]VWVKF-NH2 |
| 0624 | 1296 | Ac-SRYKWF[homoK-GMRDMKGTMS-D]VWVKF-NH2 |
| 1809 | 1297 | Ac-SHFKWH[CAMRDMKGTMSC]VWVKF-NH2 |
| 1810 | 1298 | Ac-SYYKWH[CGMRDMKGTMSC]VWVKF-NH2 |
| 1814 | 1299 | Ac-SQYKWH[CAMRDMKGTMSC]VWVKW-NH2 |
| 1818 | 1300 | Ac-SYYKWH[CGMRDMKGTYSC]VWVKF-NH2 |

FIG. 65B

| | | |
|---|---|---|
| 1819 | 1301 | Ac-SHYKWH[CAMRDMKGTMSC]VWVKF-NH2 |
| 1820 | 1302 | Ac-SHYKWH[CAMRDMKGTMSC]VWVKS-NH2 |
| 1823 | 1303 | Ac-SHYKWH[CAMRDMNGTMSC]VWVKF-NH2 |
| 1824 | 1304 | Ac-SYYKRH[CGMRDMKGTMSC]VWVKF-NH2 |
| 1827 | 1305 | Ac-SRYKWH[CAMRDMAGTMSC]VWVKF-NH2 |
| 1833 | 1306 | Ac-SYYKWH[CGMRDMKGTMSC]VWVKF-NH2 |
| 1834 | 1307 | Ac-SHYKWH[CAMRDMTGTMSC]VWVKF-NH2 |
| 1835 | 1308 | Ac-SHYKWH[CGMLDMKGTMTC]VWVKF-NH2 |
| 1836 | 1309 | Ac-HYYKWH[CGMRDMKGTMSC]VWVKF-NH2 |
| 1838 | 1310 | Ac-HYYKWH[CGMRDMKGTYSC]VWVKF-NH2 |
| 1839 | 1311 | Ac-SYYKWH[CGMRDMKGIYSC]VWVKF-NH2 |
| 1841 | 1312 | Ac-SYYKWH[CAMRDMKGTMSC]VWVKF-NH2 |
| 2316 | 1313 | Biotinyl-Ttds-SYYKWH[CAMRDMKGTMTC]VWVKF-NH2 |
| 2339 | 1314 | Ac-C(NEM)-YYKWH[CAMRDMKGTMTC]VWVKF-NH2 |
| 2340 | 1315 | Ac-C(NEM)-YKWH[CAMRDMKGTMTC]VWVKF-NH2 |
| 2343 | 1316 | Pyn-SYYKWH[CAMRDMKGTMTC]VWVKF-NH2 |
| 2344 | 1317 | Pyn-YYKWH[CAMRDMKGTMTC]VWVKF-NH2 |
| 2345 | 1318 | Pyn-YKWH[CAMRDMKGTMTC]VWVKF-NH2 |
| 2349 | 1319 | H-YYKWH[CAMRDMKGTMTC]VWVKF-NH2 |
| 2350 | 1320 | H-SYYKWH[CAMRDMKGTMTC]VWVKF-NH2 |
| 2351 | 1321 | Ac-SYYKWH[CA-Nle-RDMKGTMTC]VWVKF-NH2 |
| 2352 | 1322 | Ac-SYYKWH[CAMRD-Nle-KGTMTC]VWVKF-NH2 |
| 2353 | 1323 | Ac-SYYKWH[CAMRDMKGT-Nle-TC]VWVKF-NH2 |
| 2354 | 1324 | Ac-SYYKWH[CA-Nle-RD-Nle-KGT-Nle-TC]VWVKF-NH2 |
| 2355 | 1325 | Ac-SYYKWH[CA-Moo-RDMKGTMTC]VWVKF-NH2 |
| 2356 | 1326 | Ac-SYYKWH[CAMRD-Moo-KGTMTC]VWVKF-NH2 |
| 2357 | 1327 | Ac-SYYKWH[CAMRDMKGT-Moo-TC]VWVKF-NH2 |
| 2358 | 1328 | Ac-SYYKWH[CA-Moo-RD-Moo-KGT-Moo-TC]VWVKF-NH2 |
| 2359 | 1329 | Ac-SYYKWH[CAMRDLKGTMTC]VWVKF-NH2 |
| 2360 | 1330 | Ac-SYYKWH[CAMRDMKGTFTC]VWVKF-NH2 |
| 2376 | 1331 | Ac-SYYKWH[CAMRDLKGTFTC]VWVKF-NH2 |
| 2377 | 1332 | Ac-SYYKWH[CA-Nle-RDLKGTFTC]VWVKF-NH2 |
| 2378 | 1333 | Ac-SYYKWH[CA-Nle-RD-Nle-KGTFTC]VWVKF-NH2 |
| 2379 | 1334 | Ac-SYYKWH[CA-Moo-RDLKGTFTC]VWVKF-NH2 |
| 2380 | 1335 | Ac-SYYKWH[CA-Moo-RDLKGT-Nle-TC]VWVKF-NH2 |
| 2417 | 1336 | PEG2000-CH2-YYKWH[CAMRDMKGTMTC]VWVKF-NH2 |

FIGURE 73

| Both Nucleophilic | | Both Electrophilic | | Nucleophilic/Electrophilic | |
|---|---|---|---|---|---|
| Reactive Group 1 | Reactive Group 2 | Reactive Group 1 | Reactive Group 2 | Reactive Group 1 | Reactive Group 2 |
| amino | Amino | carboxyl | carboxyl | amino | carboxyl |
| amino | Thiol | carboxyl | acyl chloride | amino | acyl chloride |
| amino | hydroxyl | carboxyl | anhydride | amino | anhydride |
| thiol | Amino | carboxyl | Ester | amino | ester |
| thiol | Thiol | carboxyl | NHS | amino | NHS |
| thiol | hydroxyl | carboxyl | Halogen | amino | halogen |
| hydroxyl | Amino | carboxyl | sulfonate ester | amino | sulfonate ester |
| hydroxyl | Thiol | carboxyl | maleimido | amino | maleimido |
| hydroxyl | hydroxyl | carboxyl | haloacetyl | amino | haloacetyl |
| | | carboxyl | isocyanate | amino | isocyanate |
| | | acyl chloride | carboxyl | thiol | carboxyl |
| | | acyl chloride | acyl chloride | thiol | acyl chloride |
| | | acyl chloride | anhydride | thiol | anhydride |
| | | acyl chloride | Ester | thiol | ester |
| | | acyl chloride | NHS | thiol | NHS |
| | | acyl chloride | Halogen | thiol | halogen |
| | | acyl chloride | sulfonate ester | thiol | sulfonate ester |
| | | acyl chloride | maleimido | thiol | maleimido |
| | | acyl chloride | haloacetyl | thiol | haloacetyl |
| | | acyl chloride | isocyanate | thiol | isocyanate |
| | | anhydride | carboxyl | hydroxyl | carboxyl |
| | | anhydride | acyl chloride | hydroxyl | acyl chloride |
| | | anhydride | anhydride | hydroxyl | anhydride |
| | | anhydride | Ester | hydroxyl | ester |
| | | anhydride | NHS | hydroxyl | NHS |
| | | anhydride | Halogen | hydroxyl | halogen |
| | | anhydride | sulfonate ester | hydroxyl | sulfonate ester |
| | | anhydride | maleimido | hydroxyl | maleimido |
| | | anhydride | haloacetyl | hydroxyl | haloacetyl |
| | | anhydride | isocyanate | hydroxyl | isocyanate |
| | | ester | carboxyl | | |
| | | ester | acyl chloride | | |
| | | ester | anhydride | | |
| | | ester | Ester | | |
| | | ester | NHS | | |
| | | ester | Halogen | | |
| | | ester | sulfonate ester | | |
| | | ester | maleimido | | |
| | | ester | haloacetyl | | |
| | | ester | isocyanate | | |

FIGURE 73 Continued...

| Both Nucleophilic | | Both Electrophilic | | Nucleophilic/Electrophilic | |
|---|---|---|---|---|---|
| Reactive Group 1 | Reactive Group 2 | Reactive Group 1 | Reactive Group 2 | Reactive Group 1 | Reactive Group 2 |
| | | NHS | carboxyl | | |
| | | NHS | acyl chloride | | |
| | | NHS | anhydride | | |
| | | NHS | Ester | | |
| | | NHS | NHS | | |
| | | NHS | Halogen | | |
| | | NHS | sulfonate ester | | |
| | | NHS | maleimido | | |
| | | NHS | haloacetyl | | |
| | | NHS | isocyanate | | |
| | | halogen | carboxyl | | |
| | | halogen | acyl chloride | | |
| | | halogen | anhydride | | |
| | | halogen | Ester | | |
| | | halogen | NHS | | |
| | | halogen | Halogen | | |
| | | halogen | sulfonate ester | | |
| | | halogen | maleimido | | |
| | | halogen | haloacetyl | | |
| | | halogen | isocyanate | | |
| | | sulfonate ester | carboxyl | | |
| | | sulfonate ester | acyl chloride | | |
| | | sulfonate ester | anhydride | | |
| | | sulfonate ester | Ester | | |
| | | sulfonate ester | NHS | | |
| | | sulfonate ester | Halogen | | |
| | | sulfonate ester | sulfonate ester | | |
| | | sulfonate ester | maleimido | | |
| | | sulfonate ester | haloacetyl | | |
| | | sulfonate ester | isocyanate | | |
| | | maleimido | carboxyl | | |
| | | maleimido | acyl chloride | | |
| | | maleimido | anhydride | | |
| | | maleimido | Ester | | |
| | | maleimido | NHS | | |
| | | maleimido | Halogen | | |
| | | maleimido | sulfonate ester | | |
| | | maleimido | maleimido | | |
| | | maleimido | haloacetyl | | |
| | | maleimido | isocyanate | | |
| | | haloacetyl | carboxyl | | |

FIGURE 73 Continued...

| Both Nucleophilic | | Both Electrophilic | | Nucleophilic/Electrophilic | |
|---|---|---|---|---|---|
| Reactive Group 1 | Reactive Group 2 | Reactive Group 1 | Reactive Group 2 | Reactive Group 1 | Reactive Group 2 |
| | | haloacetyl | acyl chloride | | |
| | | haloacetyl | anhydride | | |
| | | haloacetyl | Ester | | |
| | | haloacetyl | NHS | | |
| | | haloacetyl | Halogen | | |
| | | haloacetyl | sulfonate ester | | |
| | | haloacetyl | maleimido | | |
| | | haloacetyl | haloacetyl | | |
| | | haloacetyl | isocyanate | | |
| | | isocyanate | carboxyl | | |
| | | isocyanate | acyl chloride | | |
| | | isocyanate | anhydride | | |
| | | isocyanate | Ester | | |
| | | isocyanate | NHS | | |
| | | isocyanate | Halogen | | |
| | | isocyanate | sulfonate ester | | |
| | | isocyanate | maleimido | | |
| | | isocyanate | haloacetyl | | |
| | | isocyanate | isocyanate | | |

FIGURE 74

```
        26        36        46        56        66        76        86
         |         |         |         |         |         |         |
HUMAN   FCAFKADDGPCKAIMKRFFFNIFTRQCEEFIYGGCEGNQNRFESLEECKKMCTRDNANRIIK
MACACA  FCAFKPDDGPCKAIMKRFFFNIFTRQCEEFIYGGCGGNQNRFESMEECKKVCTRDNVHRIIQ
RABBIT  FCAMKVDDGPCRAYIKRFFFNILAHQCEEFIYGGCEGNENRFESLEECKEKCARDYPKMTTK
MOUSE   FCAMKADDGPCKAMIRSYFFNMYTHQCEEFIYGGCEGNENRFDTLEECKKTCIPGYEKTAVK
RAT     FCAMKAEDGPCKAMIRSYFFNMNSHQCEEFIYGGCRGNKNRFDTLEECRKTCIPGYKKTTIK 97       107       117       127       137       147
         |         |         |         |         |         |
HUMAN   TTLQQEKPDFCFLEEDPGICRGYITRYFYNNQTKQCERFKYGGCLGNMNNFETLEECKNIC
MACACA  TALQQEKPDFCFLEEDPGICRGYITRYFYNNQSKQCERFKYGGCLGNMNNFETLEECKNTC
RABBIT  LTFQKGKPDFCFLEEDPGICRGYITRYFYNNQSKQCERFKYGGCLGNLNNFESLEECKNTC
MOUSE   AASGAERPDFCFLEEDPGLCRGYMKRYLYNNQTKQCERFVYGGCLGNRNNFETLDECKKIC
RAT     TTSGAEKPDFCFLEEDPGICRGFMTRYFYNNQSKQCEQFKYGGCLGNSNNFETLEECRNTC
```

HUMAN   (SEQ ID NO: 3146)
MACACA  (SEQ ID NO: 3147)
RABBIT  (SEQ ID NO: 3148)
MOUSE   (SEQ ID NO: 3149)
RAT     (SEQ ID NO: 3150)

FIGURE 76A

| Compound ID | Name | TRACER_CONC: 0.5 IC50_NUMERIC Arithmetic Mean | TRACER_CONC: 0.5 IC50_NUMERIC SD | TRACER_CONC: 0.5 IC50_NUMERIC Values | SEQ ID NO: |
|---|---|---|---|---|---|
| JBT00000415 | Ac-SRYKWF[CGMRDMKGTMSC]VWVKF-NH$_2$ | 278.44 | 37.77 | 247.36 251.81 285.62 328.97 | 1003 |
| JBT00001735 | Ac-SMYKWH[CGMRDMKGTYSC]VWVKF-NH$_2$ | 2.06 | 0.30 | 1.85 2.27 | 1026 |
| JBT00001809 | Ac-SHFKWH[CAMRDMKGTMSC]VWVKF-NH$_2$ | 2.04 | 0.74 | 1.52 2.56 | 1297 |
| JBT00001810 | Ac-SYYKWH[CGMRDMKGTMSC]VWVKF-NH$_2$ | 0.92 | 0.15 | 0.82 1.03 | 1298 |
| JBT00001816 | Ac-SYYKWH[CGMRDMKGTMSC]VWVKS-NH$_2$ | 1.63 | 0.49 | 1.28 1.98 | 1033 |
| JBT00001818 | Ac-SYYKWH[CGMRDMKGTYSC]VWVKF-NH$_2$ | 0.87 | 0.08 | 0.81 0.92 | 1300 |
| JBT00001819 | Ac-SHYKWH[CAMRDMKGTMSC]VWVKF-NH$_2$ | 1.34 | 0.21 | 1.19 1.48 | 1301 |
| JBT00001820 | Ac-SHYKWH[CAMRDMKGTMSC]VWVKS-NH$_2$ | 2.20 | 0.72 | 1.70 2.71 | 1302 |
| JBT00001822 | Ac-GHYKWH[CGMRDMKGTFSC]VWVF-NH$_2$ | 110.47 | 44.03 | 79.33 141.61 | 1036 |
| JBT00001833 | Ac-SYYKWH[CGMRDMKGTMSC]AWVKF-NH$_2$ | 1.32 | 0.25 | 1.14 1.49 | 1306 |

FIGURE 76B

| Compound ID | Name | TRACER_CONC: 0.5 IC50_NUMERIC Arithmetic Mean | TRACER_CONC: 0.5 IC50_NUMERIC SD | TRACER_CONC: 0.5 IC50_NUMERIC Values | SEQ ID NO: |
|---|---|---|---|---|---|
| JBT00001837 | Ac-SYYKWH[CAMRDMKGTMTC]VWVKF-NH$_2$ | 0.52 | 0.09 | 0.34<br>0.40<br>0.41<br>0.45<br>0.50<br>0.52<br>0.52<br>0.56<br>0.57<br>0.57<br>0.58<br>0.58<br>0.59<br>0.62<br>0.63 | 1044 |
| JBT00001838 | Ac-HYYKWH[CGMRDMKGTYSC]VWVKF-NH$_2$ | 1.04 | 0.24 | 0.87<br>1.20 | 1310 |
| JBT00001839 | Ac-SYYKWH[CGMRDMKGIYSC]VWVKF-NH$_2$ | 0.71 | 0.15 | 0.60<br>0.81 | 1311 |
| JBT00001841 | Ac-SYYKWH[CAMRDMKGTMSC]VWVKF-NH$_2$ | 0.78 | 0.01 | 0.78<br>0.79 | 1312 |
| JBT00002339 | Ac-C(NEM)-YYKWH[CAMRDMKGTMTC]VWVKF-NH$_2$ | 1.06 | | 1.06 | 1314 |
| JBT00002340 | Ac-C(NEM)-YKWH[CAMRDMKGTMTC]VWVKF-NH$_2$ | 1.75 | | 1.75 | 1315 |
| JBT00002343 | Pyn-SYYKWH[CAMRDMKGTMTC]VWVKF-NH$_2$ | 0.61 | 0.06 | 0.56<br>0.65 | 1316 |
| JBT00002344 | Pyn-YYKWH[CAMRDMKGTMTC]VWVKF-NH$_2$ | 0.72 | 0.05 | 0.69<br>0.76 | 1317 |
| JBT00002345 | Pyn-YKWH[CAMRDMKGTMTC]VWVKF-NH$_2$ | 7.75 | 2.61 | 5.90<br>9.59 | 1318 |

FIGURE 76C

| Compound ID | Name | TRACER_CONC: 0.5 IC50_NUMERIC Arithmetic Mean | TRACER_CONC: 0.5 IC50_NUMERIC SD | TRACER_CONC: 0.5 IC50_NUMERIC Values | SEQ ID NO: |
|---|---|---|---|---|---|
| JBT00002347 | Ac-SYYKWH[CAMRDMKGTMTC]VWVKF-Eag-NH$_2$ | 0.94 | | 0.937 | 1351 |
| JBT00002348 | Ac-SYYKWH[CAMRDMKGTMTC]VWVK-Eag-NH$_2$ | 0.88 | | 0.878 | 1352 |
| JBT00002349 | H-YYKWH[CAMRDMKGTMTC]VWVKF-NH$_2$ | 1.22 | | 1.22 | 1319 |
| JBT-00002350 | H-SYYKWH[CAMRDMKGTMTC]VWVKF-NH$_2$ | 0.61 | 0.01 | 0.60 0.62 | 1320 |
| JBT00002351 | Ac-SYYKWH[CA-Nle-RDMKGTMTC]VWVKF-NH$_2$ | 0.65 | 0.02 | 0.63 0.67 | 1321 |
| JBT-00002352 | Ac-SYYKWH[CAMRD-Nle-KGTMTC]VWVKF-NH$_2$ | 0.57 | 0.07 | 0.52 0.62 | 1322 |
| JBT00002353 | Ac-SYYKWH[CAMRDMKGT-Nle-TC]VWVKF-NH$_2$ | 0.56 | 0.06 | 0.53 0.60 | 1323 |
| JBT00002354 | Ac-SYYKWH[CA-Nle-RD-Nle-KGT-Nle-TC]VWVKF-NH$_2$ | 0.96 | 0.03 | 0.94 0.98 | 1324 |
| JBT00002355 | Ac-SYYKWH[CA-Moo-RDMKGTMTC]VWVKF-NH$_2$ | 0.58 | 0.06 | 0.54 0.63 | 1325 |
| JBT00002356 | Ac-SYYKWH[CAMRD-Moo-KGTMTC]VWVKF-NH$_2$ | 0.66 | 0.10 | 0.59 0.73 | 1326 |
| JBT00002357 | Ac-SYYKWH[CAMRDMKGT-Moo-TC]VWVKF-NH$_2$ | 0.60 | 0.12 | 0.52 0.69 | 1327 |
| JBT00002358 | Ac-SYYKWH[CA-Moo-RD-Moo-KGT-Moo-TC]VWVKF-NH$_2$ | 1.86 | 0.12 | 1.77 1.94 | 1328 |
| JBT00002359 | Ac-SYYKWH[CAMRDLKGTMTC]VWVKF-NH$_2$ | 0.57 | 0.03 | 0.55 0.59 | 1329 |
| JBT00002360 | Ac-SYYKWH[CAMRDMKGTFTC]VWVKF-NH$_2$ | 0.64 | 0.04 | 0.61 0.66 | 1330 |
| JBT00002376 | Ac-SYYKWH[CAMRDLKGTFTC]VWVKF-NH$_2$ | 0.74 | | 0.74 | 1331 |
| JBT00002377 | Ac-SYYKWH[CA-Nle-RDLKGTFTC]VWVKF-NH$_2$ | 1.01 | | 1.01 | 1332 |

FIGURE 76D

| Compound ID | Name | TRACER_CONC: 0.5 IC50_NUMERIC Arithmetic Mean | TRACER_CONC: 0.5 IC50_NUMERIC SD | TRACER_CONC: 0.5 IC50_NUMERIC Values | SEQ ID NO: |
|---|---|---|---|---|---|
| JBT00002378 | Ac-SYYKWH[CA-Nle-RD-Nle-KGTFTC]VWVKF-NH₂ | 1.14 | | 1.14 | 1333 |
| JBT00002379 | Ac-SYYKWH[CA-Moo-RDLKGTFTC]VWVKF-NH₂ | 0.66 | | 0.66 | 1334 |
| JBT00002380 | Ac-SYYKWH[CA-Moo-RDLKGT-Nle-TC]VWVKF-NH₂ | 0.72 | | 0.72 | 1335 |
| JBT00002417 | PEG2000-CH2-YYKWH[CAMRDMKGTMTC]VWVKF-NH₂ | 3.68 | 0.11 | 3.60 3.76 | 1336 |

FIGURE 77

| Compound ID | Name | SEQ ID NO: |
|---|---|---|
| JBT00000124 | Biotinyl-Ttds-SGASRYKWF[CGMRDMKGTMSC]VWVKFRYDTS-NH₂ | 1290 |
| JBT00000496 | Ac-SRYKWF[CG-Sem-RD-Sem-KGT-Sem-SC]VWVKF-NH2 | 1337 |
| JBT00001165 | AOA-SRYKWF[CGMRDMKGTMSC]VWVKF-NH2 | 1338 |
| JBT00002330 | Ac-SYYKWH[CAMRDMKGTMTC]VWVKF-Con(Meox)-NH₂ | 1339 |
| JBT00002331 | Ac-SYYKWH[CAMRDMKGTMTC]VWVK-Con(Meox)-NH₂ | 1340 |
| JBT00002332 | Ac-SYYKWH[CAMRDM-Con(Meox)-GTMTC]VWVKF-NH₂ | 1341 |
| JBT00002333 | Oxme-Aoa-SYYKWH[CAMRDMKGTMTC]VWVKF-NH₂ | 1342 |
| JBT00002334 | Oxme-Aoa-YYKWH[CAMRDMKGTMTC]VWVKF-NH₂ | 1343 |
| JBT00002335 | Oxme-Aoa-YKWH[CAMRDMKGTMTC]VWVKF-NH₂ | 1344 |
| JBT00002336 | Meox-Lev-SYYKWH[CAMRDMKGTMTC]VWVKF-NH₂ | 1345 |
| JBT00002337 | Meox-Lev-YYKWH[CAMRDMKGTMTC]VWVKF-NH₂ | 1346 |
| JBT00002338 | Meox-Lev-YKWH[CAMRDMKGTMTC]VWVKF-NH₂ | 1347 |
| JBT00002346 | Ac-SYYKWH[CAMRDM-Eag-GTMTC]VWVKF-NH₂ | 1350 |
| JBT00002347 | Ac-SYYKWH[CAMRDMKGTMTC]VWVKF-Eag-NH₂ | 1351 |
| JBT00002348 | Ac-SYYKWH[CAMRDMKGTMTC]VWVK-Eag-NH₂ | 1352 |
| JBT00002456 | FAM-SYYKWH[CAMRDMKGTMTC]VWVKF-NH₂ | 1353 |
| JBT00002457 | FAM-Ttds-ASMTKF[CKWVMKTYRMYC]HGVDW-NH₂ | 1354 |
| JBT00002538 | Ac-SYYKWH[CAMRD-SeMet-KGT-SeMet-TC]VWVKF-NH₂ | 1355 |

FIGURE 78A

| Compound ID | Name | IC50 ELISA | | 24 h Koff ELISA | 24 h Human Plasma Stability | | 24 h Mouse Plasma Stability | |
|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00000293 | Ac-FQSKKNVFVFGYFERLRAKL-NH2 | 18468.82 | >1000.00<br>3396.67<br>>5000.00<br>8513.19<br>9961.37<br>12061.10<br>13202.76<br>16369.51<br>16609.04<br>38403.84<br>47701.88 | | | | | |
| JBT00000303 | Ac-FQSKKNVFVDGYFERLRAKL-NH2 | 439.39 | 314.91<br>335.86<br>432.05<br>674.75 | | | | | |
| JBT00000375 | Ac-FQSKGNVFVFGYFERLRAKL-NH2 | 440.11 | 326.63<br>331.22<br>384.44<br>718.16 | | | | | |
| JBT00000477 | Ac-FQSKGNVFVDGYFERLRAKL-NH2 | 86.96 | 40.42<br>74.01<br>79.67<br>112.19<br>128.50 | | | | | |
| JBT00000477 | Ac-FQSKGNVFVDGYFERLRAKL-NH2 | 77.64 | 77.64 | | | | | |
| JBT00000477 | Ac-FQSKGNVFVDGYFERLRAKL-NH2 | 146.70 | 72.95<br>220.46 | | | | | |

FIGURE 78B

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00000500 | Ac-FQSK-Nmg-NVFGYFERLRAKL-NH2 | 93.36 | 85.86 92.90 93.89 100.79 | | | | | | |
| JBT00000740 | Ac-FQSKGNVFVDGYFERL-Aib-AKL-NH2 | 34.51 | 21.88 25.82 27.37 29.95 46.60 55.46 | | | | | | |
| JBT00000758 | Ac-FQSkKNVFVFGYFERLRAKL-NH2 | 2286.18 | >500.00 2194.24 2231.70 2432.61 | | | | | | |
| JBT00000759 | Ac-FQSKkNVFVFGYFERLRAKL-NH2 | 632.32 | >500.00 552.42 661.62 682.92 | | | | | | |
| JBT00001156 | Ac-FQSKaNVFVDGYFARL-Nle-AKL-NH2 | 416.11 | 294.77 537.44 | | | | | | |
| JBT00001319 | Ac-YQSKNNVFVDGYFERLCAKL-NH2 | 137.20 | 137.20 | | | | | | |
| JBT00001320 | Ac-FQSKERVFVDGYFERLCAKL-NH2 | 364.74 | 364.74 | | | | | | |
| JBT00001584 | Ac-FQSK-Nmg-NVFVDGYFERL-Aib-AKL-NH2 | 5.30 | 3.04 3.59 7.08 7.48 | | | | | | |

FIGURE 78C

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00001585 | Ac-FQSK-Nmg-NVFVTGYFERL-Aib-AKL-NH2 | 15.14 | 8.67 | | | | | | |
| | | | 9.82 | | | | | | |
| | | | 20.55 | | | | | | |
| | | | 21.54 | | | | | | |
| JBT00001855 | Ac-FQSKGNVFVDGYFERL-Aib-AKLC(PEG)-NH2 | 121.04 | 60.78 | | | | | | |
| | | | 66.26 | | | | | | |
| | | | 78.60 | | | | | | |
| | | | 121.81 | | | | | | |
| | | | 162.52 | | | | | | |
| | | | 236.24 | | | | | | |
| JBT00001856 | Ac-FQSKpNVFVDGYFERL-Aib-AKL-NH2 | 4.57 | 3.98 | | | | | | |
| | | | 4.23 | | | | | | |
| | | | 4.24 | | | | | | |
| | | | 5.85 | | | | | | |

FIGURE 78D

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00001857 | Ac-FQSKpNVHVDGYFERL-Aib-AKL-NH2 | 3.08 | 1.48<br>2.07<br>2.10<br>2.16<br>2.20<br>2.53<br>2.69<br>2.99<br>3.03<br>3.11<br>3.13<br>3.21<br>3.36<br>3.51<br>3.52<br>3.69<br>3.70<br>4.23<br>5.90 | 11.14 | 4.30<br>4.60<br>5.90<br>6.90<br>7.90<br>11.10<br>22.10<br>26.30 | 27.30 | 26.30<br>28.30 | 1.40 | 1.40 |

FIGURE 78E

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00001857 | Ac-FQSKpNVHVDGYFERL-Aib-AKL-NH2 | 3.17 | 1.69 | 12.58 | 4.70 | | | | |
| | | | 2.32 | | 7.30 | | | | |
| | | | 2.41 | | 9.20 | | | | |
| | | | 2.65 | | 11.20 | | | | |
| | | | 2.83 | | 12.30 | | | | |
| | | | 2.89 | | 13.20 | | | | |
| | | | 2.97 | | 14.20 | | | | |
| | | | 3.03 | | 14.20 | | | | |
| | | | 3.11 | | 14.30 | | | | |
| | | | 3.15 | | 16.10 | | | | |
| | | | 3.26 | | 16.40 | | | | |
| | | | 3.39 | | 17.80 | | | | |
| | | | 4.09 | | | | | | |
| | | | 4.13 | | | | | | |
| | | | 4.20 | | | | | | |
| | | | 4.55 | | | | | | |
| JBT00002258 | Ac-FQSKKNVFV-NH2 | | >5000.00 | | | | | | |
| JBT00002262 | FAM-Ttds-FQSK-Nmg-NVFVDGYFERL-Aib-AKL-NH2 | 13.40 | 7.45 | | | | | | |
| | | | 10.09 | | | | | | |
| | | | 17.56 | | | | | | |
| | | | 18.50 | | | | | | |
| JBT00002270 | Ac-PEFQSK-Nmg-NVFVDGYFERL-Aib-AKL-NH2 | 1.94 | 1.72 | 9.80 | 9.80 | | | | |
| | | | 2.15 | | | | | | |
| JBT00002274 | Ac-FQSK-NpropylG-NVHVDGYFERL-Aib-AKL-NH2 | 4.34 | 3.72 | 2.30 | 2.30 | | | | |
| | | | 4.96 | | | | | | |

FIGURE 78F

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002275 | Ac-FQSK-aze-NVHVDGYFERL-Aib-AKL-NH2 | 2.74 | 1.25<br>2.07<br>2.69<br>3.69<br>4.02 | 8.60 | 8.60 | | | | |
| JBT00002276 | Ac-FQSK-pip-NVHVDGYFERL-Aib-AKL-NH2 | 3.27 | 1.49<br>2.06<br>2.95<br>3.43<br>3.59<br>6.08 | 4.70 | 4.70 | | | | |
| JBT00002277 | Ac-FQSK-tic-NVHVDGYFERL-Aib-AKL-NH2 | 3.86 | 2.23<br>3.06<br>4.49<br>4.74<br>4.78 | 0.30 | 0.30 | | | | |
| JBT00002278 | Ac-FQSK-oic-NVHVDGYFERL-Aib-AKL-NH2 | 2.75 | 1.82<br>3.69 | 25.00 | 15.10<br>34.90 | | | | |
| JBT00002279 | Ac-FQSK-hyp-NVHVDGYFERL-Aib-AKL-NH2 | 2.72 | 1.54<br>2.19<br>3.03<br>3.16<br>3.68 | 9.00 | 9.00 | | | | |
| JBT00002280 | Ac-FQSK-nma-NVHVDGYFERL-Aib-AKL-NH2 | 4.60 | 4.56<br>4.65 | 3.40 | 3.40 | | | | |
| JBT00002281 | Ac-FQSK-Ncg-NVHVDGYFERL-Aib-AKL-NH2 | 6.08 | 5.77<br>6.38 | 1.80 | 1.80 | 17.40 | 17.40 | | |
| JBT00002282 | Ac-FQSK-Abg-NVHVDGYFERL-Aib-AKL-NH2 | 9.98 | 9.95 | 5.90 | 5.90 | | | | |

FIGURE 78G

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002283 | Ac-FQSK-Apg-NVHVDGYFERL-Aib-AKL-NH2 | 20.12 | 10.01 | | | | | | |
| | | | 16.62 | 6.50 | 6.50 | 46.70 | 46.70 | | |
| | | | 23.63 | | | | | | |
| JBT00002284 | Ac-FQSK-thz-NVHVDGYFERL-Aib-AKL-NH2 | 671.59 | 671.59 | 1.00 | 1.00 | | | | |
| JBT00002285 | Ac-FQSK-dtc-NVHVDGYFERL-Aib-AKL-NH2 | 3.44 | 2.80 | 19.40 | 19.40 | | | | |
| | | | 4.07 | | | | | | |
| JBT00002287 | Ac-FQSKp-Nmn-VHVDGYFERL-Aib-AKL-NH2 | | >500.00 | | | | | | |
| JBT00002288 | Ac-FQSKp-Nma-VHVDGYFERL-Aib-AKL-NH2 | | >5000.00 | | | | | | |
| JBT00002289 | Ac-FQSKp-Nmk-VHVDGYFERL-Aib-AKL-NH2 | | >5000.00 | | | | | | |
| JBT00002290 | Ac-FQSKp-Nmr-VHVDGYFERL-Aib-AKL-NH1 | | >5000.00 | | | | | | |
| JBT00002291 | Ac-FQSKp-Nms-VHVDGYFERL-Aib-AKL-NH2 | 644.27 | 515.17 | | | | | | |
| | | | 773.37 | | | | | | |
| JBT00002292 | Ac-FQSKpnVHVDGYFERL-Aib-AKL-NH2 | 1124.91 | >1000.00 | | | | | | |
| | | | 1124.91 | | | | | | |
| JBT00002293 | Ac-FQSKpN-Chg-HVDGYFERL-Aib-AKL-NH2 | 45.13 | 43.57 | 4.60 | 4.60 | | | 4.10 | 4.10 |
| | | | 46.69 | | | | | | |
| JBT00002294 | Ac-FQSKpNVH-Chg-DGYFERL-Aib-AKL-NH2 | 332.48 | 191.09 | | | 27.60 | 27.60 | 5.40 | 5.40 |
| | | | 335.09 | | | | | | |
| | | | 471.25 | | | | | | |
| JBT00002295 | Ac-FQSKpN-Chg-H-Chg-DGYFERL-Aib-AKL-NH2 | | >5000.00 | | | | | | |
| JBT00002296 | Ac-FQSKpN-Phg-HVDGYFERL-Aib-AKL-NH2 | 639.17 | 515.14 | | | | | | |
| | | | 763.19 | | | | | | |
| JBT00002297 | Ac-FQSKpNVH-Phg-DGYFERL-Aib-AKL-NH2 | 66.94 | 41.08 | | | 34.70 | 34.70 | 4.80 | 4.80 |
| | | | 74.17 | | | | | | |
| | | | 85.57 | | | | | | |
| JBT00002298 | Ac-FQSKpN-Phg-H-Phg-DGYFERL-Aib-AKL-NH2 | | >5000.00 | | | | | | |
| JBT00002299 | Ac-FQSKpNVHVDGYFERL-Deg-AKL-NH2 | 3.01 | 2.25 | 16.90 | 16.90 | | | | |
| | | | 3.76 | | | | | | |

FIGURE 78H

| Compound ID | Name | IC50 ELISA Mean IC50 [nM] | IC50 ELISA IC50 [nM] | 24 h Koff ELISA INHIBITION [%] | 24 h Koff ELISA INHIBITION [%] | 24 h Human Plasma Stability Mean Remaining [%] | 24 h Human Plasma Stability Remaining [%] | 24 h Mouse Plasma Stability Mean Remaining [%] | 24 h Mouse Plasma Stability Remaining [%] |
|---|---|---|---|---|---|---|---|---|---|
| JBT00002300 | Ac-FQSKpNVHVDGYFERL-Ebc-AKL-NH2 | 8.39 | 5.58 6.03 8.20 10.39 11.75 | -1.60 | -1.60 | | | | |
| JBT00002301 | Ac-FQSKpNVHVDGYFERL-Eca-AKL-NH2 | 3.36 | 2.57 2.60 4.92 | 12.10 | 12.10 | | | | |
| JBT00002302 | Ac-FQSKpNVHVDGYFERL-Egz-AKL-NH2 | 2.70 | 2.56 2.84 | 10.90 | 10.90 | | | | |
| JBT00002303 | Ac-FQSKpNVHVDGYFERL-Aic-AKL-NH2 | 3.04 | 2.64 3.43 | 13.20 | 13.20 | | | | |
| JBT00002304 | Ac-FQSKpNVHVDGYFERL-Apc-AKL-NH2 | 2.22 | 1.90 2.54 | 14.20 | 14.20 | | | | |
| JBT00002305 | Ac-FQSKpNVHVDGYFERL-Egt-AKL-NH2 | 4.48 | 3.74 5.22 | 8.30 | 8.30 | | | | |
| JBT00002306 | Ac-1Ni-QSKpNVHVDGYFERL-Aib-AKL-NH2 | 3.13 | 2.58 3.68 | 19.50 | 19.50 | 19.30 | 19.30 | 0.00 | 0.00 |
| JBT00002307 | Ac-Thi-QSKpNVHVDGYFERL-Aib-AKL-NH2 | 3.41 | 3.25 3.58 | 12.60 | 12.60 | 19.80 | 19.80 | 1.20 | 1.20 |
| JBT00002308 | Ac-Bta-QSKpNVHVDGYFERL-Aib-AKL-NH2 | 3.04 | 2.22 3.87 | 18.10 | 18.10 | 18.65 | 15.70 21.60 | 0.00 | 0.00 |
| JBT00002309 | Ac-FQSKpNVHVDGY-1Ni-ERL-Aib-AKL-NH2 | 1.97 | 1.39 1.44 1.77 1.91 3.36 | 21.70 | 21.70 | | | 6.30 | 6.30 |

FIGURE 78I

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002310 | Ac-FQSKpNVHVDGY-Thi-ERL-Aib-AKL-NH2 | 3.81 | 1.82<br>3.80<br>4.27<br>4.57<br>4.60 | 10.00 | 10.00 | | | | |
| JBT00002311 | Ac-FQSKpNVHVDGY-Bta-ERL-Aib-AKL-NH2 | 2.30 | 1.65<br>1.71<br>2.44<br>3.38 | 28.30 | 28.30 | 46.64 | 35.90<br>38.70<br>41.80<br>43.60<br>73.20 | 6.10 | 6.10 |
| JBT00002312 | Ac-FQSKpNVHVDG-Tym-FERL-Aib-AKL-NH2 | 194.26 | 156.94<br>231.59 | | | | | | |
| JBT00002313 | Ac-FQSKpNVHVDG-Pty-FERL-Aib-AKL-NH2 | 257.97 | 230.29<br>285.65 | | | | | | |
| JBT00002314 | Ac-FQSKpNVHVDG-Pmy-FERL-Aib-AKL-NH2 | 5.14 | 4.21<br>6.07 | 7.40 | 7.40 | | | 7.30 | 7.30 |
| JBT00002315 | Ac-FQSKpNVHVDGYFERL-Aib-AKLC-NH2 | 6.12 | 2.49<br>5.36<br>6.90<br>7.04<br>8.80 | | | | | | |

FIGURE 78J

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002317 | Ac-FQSKpNVHVDGYFERL-Aib-AKLC(NEM)-NH2 | 3.53 | 2.26<br>2.37<br>2.54<br>3.08<br>3.32<br>3.53<br>3.58<br>3.72<br>3.97<br>4.31<br>4.42<br>5.26 | 12.73 | 9.60<br>10.70<br>17.90 | 23.77 | 18.20<br>21.00<br>32.10 | 15.95 | 3.40<br>28.50 |
| JBT00002319 | Ac-VF-Aib-EVLKFGHALKpNSQDRY-NH2 | | >50000.00<br>>50000.00<br>>50000.00<br>>50000.00 | | | | | | |
| JBT00002320 | Ac-FpDYVER-Aib-KGFLVHQKLASN-NH2 | | >50000.00<br>>50000.00<br>>50000.00 | | | | | | |
| JBT00002325 | Ac-FQSKpNVHVDGYFERL-Aib-AKLC(ME-50MA)-NH2 | 6.60 | 5.96<br>6.62<br>6.64<br>7.16 | 3.70 | 3.70 | 67.60 | 67.60 | 44.70 | 44.70 |
| JBT00002326 | Ac-FQSKpNVHVDGYFERL-Aib-AKLC(ME-120MA)-NH2 | 9.30 | 7.91<br>9.57<br>10.43 | 4.30 | 4.30 | 58.70 | 58.70 | 57.20 | 57.20 |

FIGURE 78K

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002327 | Ac-FQSKpNVHVDGYFERL-Aib-AKLC(ME-200MA0B)-NH2 | 10.92 | 8.98<br>11.80<br>11.99 | 5.00 | 5.00 | 76.50 | 76.50 | 65.50 | 65.50 |
| JBT00002328 | Ac-FQSKpNVHVDGYFERL-Aib-AKLC(ME-300MA)-NH2 | 12.29 | 8.99<br>13.92<br>13.97 | 2.70 | 2.70 | 68.40 | 68.40 | 51.00 | 51.00 |
| JBT00002329 | Ac-FQSKpNVHVDGYFERL-Aib-AKLC(ME-400MA)-NH2 | 16.43 | 8.41<br>10.74<br>11.39<br>11.93<br>12.24<br>13.46<br>13.88<br>15.67<br>16.98<br>18.48<br>18.97<br>19.77<br>21.20<br>36.94 | 14.27 | 11.60<br>15.10<br>16.10 | 69.50 | 64.10<br>74.90 | 69.50 | 69.50 |

FIGURE 78L

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002329 | Ac-FQSKpNVHVDGYFERL-Aib-AKLC(ME-400MA)-NH2 | 14.77 | 7.24<br>7.29<br>7.43<br>7.43<br>7.49<br>12.33<br>16.91<br>17.73<br>18.80<br>20.15<br>20.52<br>33.87 | | | 62.90 | 62.90 | 81.80 | 81.80 |
| JBT00002329 | Ac-FQSKpNVHVDGYFERL-Aib-AKLC(ME-400MA)-NH2 | 19.03 | 13.25<br>16.78<br>27.06 | | | | | | |
| JBT00002329 | Ac-FQSKpNVHVDGYFERL-Aib-AKLC(ME-400MA)-NH2 | 15.57 | 10.82<br>11.20<br>11.91<br>12.87<br>13.35<br>13.74<br>16.31<br>21.18<br>28.75 | | | | | | |
| JBT00002329 | Ac-FQSKpNVHVDGYFERL-Aib-AKLC(ME-400MA)-NH2 | 18.54 | 14.70<br>17.79<br>23.13 | | | | | | |

FIGURE 78M

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002329 | Ac-FQSKpNVHVDGYFERL-Aib-AKLC(ME-400MA)-NH2 | 20.76 | 20.57 / 20.96 | | | 59.30 | 59.30 | 56.70 | 56.70 |
| JBT00002366 | Ac-Bta-QSKpNVHVDGY-1Ni-ERL-Aib-AKL-NH2 | 1.99 | 1.85 / 2.13 | 8.30 | 8.30 | | | | |
| JBT00002367 | Ac-Bta-QSKpNVHVDGY-Bta-ERL-Aib-AKL-NH2 | 2.05 | 1.83 / 2.28 | 12.80 | 12.80 | | | | |
| JBT00002368 | Ac-1Ni-QSKpNVHVDGY-1Ni-ERL-Aib-AKL-NH2 | 2.32 | 2.10 / 2.55 | 11.10 | 11.10 | | | | |
| JBT00002369 | Ac-1Ni-QSKpNVHVDGY-Bta-ERL-Aib-AKL-NH2 | 2.03 | 1.90 / 2.16 | 12.00 | 12.00 | | | | |
| JBT00002370 | Ac-FQSKpCVHVDGYFERL-Aib-AKL-NH2 | 6.33 | 4.04 / 8.62 | | | | | | |
| JBT00002371 | Ac-FQSKpNVHVCGYFERL-Aib-AKL-NH2 | 10.67 | 5.48 / 15.86 | | | 31.20 | 31.20 | | |
| JBT00002372 | Ac-FQSKpNVHVDGYCERL-Aib-AKL-NH2 | 11.68 | 8.14 / 15.23 | | | | | | |
| JBT00002373 | Ac-FQSKpNVHVDGYFCRL-Aib-AKL-NH2 | 4.07 | 3.12 / 5.02 | | | | | | |
| JBT00002381 | Ac-FQSKpNVH-Abu-DGYFERL-Aib-AKLC(NEM)-NH2 | 3.45 | 2.34 / 4.56 | 1.90 | 1.90 | 17.30 | 17.30 | | |
| JBT00002382 | Ac-FQSKpNVH-(L-2-Amino-4,4,4-trifluorobutyric acid)-DGYFERL-Aib-AKLC(NEM)-NH2 | 62.74 | 43.29 / 82.19 | -2.20 | -2.20 | 20.50 | 20.50 | | |
| JBT00002383 | Ac-FQSKpNVH-Cpg-DGYFERL-Aib-AKLC(NEM)-NH2 | 52.18 | 40.44 / 63.91 | -4.20 | -4.20 | 31.00 | 31.00 | | |
| JBT00002384 | Ac-FQSKpNVHvDGYFERL-Aib-AKLC(NEM)-NH2 | >500.00 | | -0.80 | -0.80 | 51.50 | 51.50 | | |
| JBT00002385 | Ac-FQSKpNVH-Aib-DGYFERL-Aib-AKLC(NEM)-NH2 | 24.23 | 18.11 / 30.36 | | | | | | |

FIGURE 78N

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002386 | Ac-FQSKpNVH-Tle-DGYFERL-Aib-AKLC(NEM)-NH2 | 4.92 | 1.97<br>3.64<br>3.66<br>3.68<br>4.03<br>4.22<br>6.17<br>6.49<br>10.46 | 11.93 | 6.50<br>9.30<br>11.50<br>12.10<br>15.70<br>16.50 | 52.00 | 52.00 | | |
| JBT00002387 | Ac-FQSKpNVH-Nmv-DGYFERL-Aib-AKLC(NEM)-NH2 | | >500.00 | | | | | | |
| JBT00002388 | Ac-FQSKpNVHV-Nmd-GYFERL-Aib-AKLC(NEM)-NH2 | 9.62 | 7.02<br>12.22 | 1.60 | 1.60 | 46.50 | 46.50 | | |
| JBT00002389 | Ac-FQSKpNVHVHGYFERL-Aib-AKLC(NEM)-NH2 | 4.40 | 2.97<br>5.83 | 16.50 | 16.50 | 18.60 | 18.60 | | |
| JBT00002390 | Ac-FQSKpNVHVSGYFERL-Aib-AKLC(NEM)-NH2 | 2.97 | 2.26<br>3.68 | 10.00 | 10.00 | 33.40 | 33.40 | | |
| JBT00002391 | Ac-FQSKpNVHVTGYFERL-Aib-AKLC(NEM)-NH2 | 3.05 | 2.90<br>3.19 | 11.20 | 11.20 | 41.40 | 41.40 | | |
| JBT00002392 | Ac-FQSKpNVHVPGYFERL-Aib-AKLC(NEM)-NH2 | 2.62 | 2.05<br>3.20 | 12.80 | 12.80 | 58.00 | 58.00 | | |
| JBT00002393 | Ac-FQSKpNVHVdGYFERL-Aib-AKLC(NEM)-NH2 | 32.75 | 24.71<br>40.80 | -0.50 | -0.50 | 70.90 | 70.90 | | |
| JBT00002394 | Ac-FQSKpNVH-Tle-PGYFERL-Aib-AKLC(NEM)-NH2 | 5.53 | 4.04<br>7.02 | 5.80 | 5.80 | 55.90 | 55.90 | | |
| JBT00002395 | Ac-FQSKpNVH-Tle-TGYFERL-Aib-AKLC(NEM)-NH2 | 4.37 | 3.32<br>5.43 | 9.70 | 9.70 | 52.60 | 52.60 | | |
| JBT00002396 | Ac-FQSKpNVHVDAYFERL-Aib-AKLC(NEM)-NH2 | 31.54 | 23.49<br>39.59 | -0.50 | -0.50 | 17.90 | 17.90 | | |

FIGURE 78O

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002397 | Ac-FQSKp-C(NEM)-VHVDGYFERL-Aib-AKL-NH2 | 3.30 | 1.93<br>3.52<br>4.44 | 39.73 | 27.60<br>40.30<br>43.30<br>47.70 | 10.60 | 10.60 | | |
| JBT00002397<br>JBT00002398 | Ac-FQSKp-C(NEM)-VHVDGYFERL-Aib-AKL-NH2<br>Ac-FQSKpNVHV-C(NEM)-GYFERL-Aib-AKL-NH2 | 3.45<br>4.29 | 3.45<br>3.26<br>5.33 | 43.30<br>4.10 | 43.30<br>4.10 | 39.05 | 33.90<br>44.20 | 21.60 | 21.60 |
| JBT00002399 | Ac-FQSKpNVHVDGYF-C(NEM)-RL-Aib-AKL-NH2 | 4.23 | 3.35<br>5.12 | 11.20 | 11.20 | 10.70 | 10.70 | | |
| JBT00002400 | Ac-FQSKpNVHVDGYFERL-Aib-AKLK(Tds-Maleimidopropionyl(EtSH))-NH2 | 4.02 | 2.17<br>3.13<br>3.57<br>4.63<br>6.59 | 23.40 | 23.10<br>23.70 | 60.00 | 60.00 | | |
| JBT00002401 | Ac-FQSKpNVHVDGYFERL-Aib-AKLC(Y-MAL-40K)-NH2 | 31.42 | 14.47<br>18.58<br>44.37<br>48.26 | 21.40 | 21.40 | 83.70 | 77.40<br>90.00 | 112.10 | 112.10 |
| JBT00002401<br>JBT00002402 | Ac-FQSKpNVHVDGYFERL-Aib-AKLC(Y-MAL-40K)-NH2<br>Ac-FQSKp-C(ME-400MA)-VHVDGYFERL-Aib-AKL-NH2 | 35.52<br>20.46 | 35.52<br>12.29<br>12.91<br>36.18 | 28.90 | 28.90 | 87.90<br>75.30 | 87.90<br>53.30<br>73.70<br>98.90 | 99.70 | 99.70 |
| JBT00002403 | Ac-FQSKpNVHV-C(ME-400MA)-GYFERL-Aib-AKL-NH2 | 22.89 | 15.60<br>17.55<br>35.52 | 6.30 | 6.30 | 96.70 | 74.30<br>102.90<br>112.90 | 92.50 | 92.50 |

FIGURE 78P

| Compound ID | Name | IC50 ELISA Mean IC50 [nM] | IC50 ELISA IC50 [nM] | 24 h ELISA INHIBITION [%] | 24 h Koff ELISA INHIBITION [%] | 24 h Human Plasma Stability Mean Remaining [%] | 24 h Human Plasma Stability Remaining [%] | 24 h Mouse Plasma Stability Mean Remaining [%] | 24 h Mouse Plasma Stability Remaining [%] |
|---|---|---|---|---|---|---|---|---|---|
| JBT00002404 | Ac-FQSKpNVHVDGYF-C(ME-400MA)-RL-Aib-AKL-NH2 | 24.31 | 13.60<br>16.36<br>33.41<br>33.87 | 14.90 | 14.90 | 96.60 | 70.70<br>122.50 | 93.20 | 93.20 |
| JBT00002404 | Ac-FQSKpNVHVDGYF-C(ME-400MA)-RL-Aib-AKL-NH2 | 31.65 | 31.65 | | | 96.90 | 96.90 | | |
| JBT00002405 | [FQSKpNVHVDGYFERL-Aib-AKL-FA19205] | 38.76 | 38.76 | | | 55.90 | 55.90 | | |
| JBT00002406 | [FQSKpNVHVDGYFERL-Aib-AKL-FA19204] | 75.35 | 67.04<br>83.66 | | | 62.80 | 62.80 | 38.10 | 38.10 |
| JBT00002407 | [FQSKpNVHVDGYFERL-Aib-AKL-FA19203] | 28.48 | 20.94<br>36.01 | 24.00 | 24.00 | 45.20 | 45.20 | | |
| JBT00002408 | [FQSKpNVHVDGYFERL-Aib-AKL-FA03202] | 65.52 | 56.17<br>74.88 | | | 61.60 | 61.60 | 39.40 | 39.40 |
| JBT00002410 | Ac-FQSKpNVHVDGYFERL-Aib-AKLK(Ttds-Maleimid-HSA)-NH2 | 6.90 | 4.72<br>6.03<br>9.95 | | | | | | |
| JBT00002410 | Ac-FQSKpNVHVDGYFERL-Aib-AKLK(Ttds-Maleimid-HSA)-NH2 | 6.21 | 4.33<br>4.83<br>6.07<br>9.62 | 31.80 | 31.80 | 65.70 | 25.90<br>76.80<br>94.40 | 79.15 | 55.40<br>102.90 |
| JBT00002410 | Ac-FQSKpNVHVDGYFERL-Aib-AKLK(Ttds-Maleimid-HSA)-NH2 | 4.59 | 4.59 | | | | | | |
| JBT00002411 | Ac-FQSKpKVH-Tle-DGYFERL-Aib-AKL-NH2 | 4.61 | 3.05<br>5.36<br>5.41 | 16.80 | 14.10<br>19.50 | | | | |
| JBT00002412 | Ac-FQSKp-Cit-VH-Tle-DGYFERL-Aib-AKL-NH2 | 6.09 | 4.43<br>7.75 | 4.40 | 4.40 | | | | |
| JBT00002413 | Ac-FQSKpVVH-Tle-DGYFERL-Aib-AKL-NH2 | 8.60 | 5.98<br>11.22 | -2.80 | -2.80 | | | | |

FIGURE 78Q

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002414 | Ac-FQSKpNVH-Tle-DaYFERL-Aib-AKL-NH2 | 6.22 | 4.03 4.92 5.15 5.32 6.31 6.78 7.52 7.89 8.06 | 3.17 | -3.60 1.50 11.60 | 100.50 | 93.10 107.90 | 47.25 | 46.80 47.70 |
| JBT00002415 | Ac-FQSKp-C(Acm)-VH-Tle-DGYFERL-Aib-AKL-NH2 | 4.45 | 3.35 3.41 3.66 4.58 5.04 6.64 | 11.40 | 4.80 6.20 9.30 25.30 | 81.20 | 81.20 | 36.10 | 36.10 |
| JBT00002416 | Ac-FQSKp-Nle-VH-Tle-DGYFERL-Aib-AKL-NH2 | 7.72 | 5.89 9.54 | 5.40 | 5.40 | | | | |
| JBT00002418 | Ac-FQSKpRVH-Tle-DGYFERL-Aib-AKL-NH2 | 3.12 | 3.12 | 20.60 | 20.60 | 66.10 | 66.10 | | |
| JBT00002419 | Ac-FQSKpSVH-Tle-DGYFERL-Aib-AKL-NH2 | 3.23 | 3.23 | 13.00 | 13.00 | | | | |
| JBT00002420 | Ac-FQSKplVH-Tle-DGYFERL-Aib-AKL-NH2 | 7.33 | 7.33 | 0.90 | 0.90 | | | | |
| JBT00002421 | Ac-FQSKpNVH-Tle-D-Sar-YFERL-Aib-AKL-NH2 | 19.51 | 19.51 | 1.60 | 1.60 | | | | |
| JBT00002422 | Ac-FQSKpNVH-Tle-DpYFERL-Aib-AKL-NH2 | 28.02 | 28.02 | 1.10 | 1.10 | | | | |
| JBT00002423 | Ac-FQSKpNVH-Tle-DGYFERL-Aib-LKL-NH2 | 3.56 | 3.56 | 8.90 | 8.90 | 78.70 | 78.70 | 13.70 | 13.70 |
| JBT00002424 | Ac-FQSKpNVH-Tle-DGYFERL-Aib-Nle-KL-NH2 | 4.37 | 4.37 | 8.20 | 8.20 | 90.10 | 90.10 | 17.00 | 17.00 |
| JBT00002425 | Ac-FQSKpNVH-Tle-DGYFERL-Aib-A-Nmk-L-NH2 | >500.00 | >500.00 | | | | | | |
| JBT00002426 | Ac-FQDKpNVH-Tle-DGYFERL-Aib-AKL-NH2 | 10.46 | 10.46 | 0.10 | 0.10 | | | | |
| JBT00002427 | Ac-FQEKpNVH-Tle-DGYFERL-Aib-AKL-NH2 | 5.24 | 5.24 | 14.10 | 14.10 | | | | |
| JBT00002428 | Ac-FQVH-Tle-DGYFERL-Aib-AKL-NH2 | >500.00 | >500.00 | | | | | | |

FIGURE 78R

| Compound ID | Name | IC50 ELISA Mean IC50 [nM] | IC50 ELISA IC50 [nM] | 24 h Koff ELISA INHIBITION [%] | 24 h Koff ELISA INHIBITION [%] | 24 h Human Plasma Stability Mean Remaining [%] | 24 h Human Plasma Stability Remaining [%] | 24 h Mouse Plasma Stability Mean Remaining [%] | 24 h Mouse Plasma Stability Remaining [%] |
|---|---|---|---|---|---|---|---|---|---|
| JBT00002429 | Ac-FqVH-Tle-DGYFERL-Aib-AKL-NH2 | | >500.00 | | | | | | |
| JBT00002430 | Ac-FQSKpNVHVDGYFERL-Aib-AKLK(AOA-40kDa PSA)-NH2 | 15.45 | 15.45 | | | | | | |
| JBT00002430 | Ac-FQSKpNVHVDGYFERL-Aib-AKLK(AOA-40kDa PSA)-NH2 | | | 40.95 | 39.50 42.40 | 135.60 | 124.20 147.00 | 122.60 | 119.10 126.10 |
| JBT00002431 | Ac-FQSKpNVH-Tle-DGYFERL-Aib-AKL-NH2 | 4.74 | 4.67 4.80 | 5.10 | 5.10 | 81.90 | 81.90 | 42.60 | 42.60 |
| JBT00002432 | Ac-FQSKpNVHVPGYFERL-Aib-AKL-NH2 | 3.76 | 3.45 4.06 | 6.70 | 6.70 | 76.30 | 76.30 | | |
| JBT00002433 | Ac-FQSKpNVHVPaYFERL-Aib-AKL-NH2 | 5.71 | 5.01 6.40 | 17.80 | 17.80 | 99.30 | 99.30 | 27.30 | 27.30 |
| JBT00002434 | Ac-FQSKpNVHVPGYF-Aib-RL-Aib-AKL-NH2 | 5.53 | 5.22 5.84 | 13.75 | 7.70 8.60 9.60 29.10 | 99.55 | 77.50 121.60 | 31.20 | 31.20 |
| JBT00002435 | Ac-FQSKpNVH-Tle-DaYFERL-Aic-AKL-NH2 | 8.00 | 7.47 8.54 | 4.80 | 4.80 | 103.95 | 87.90 120.00 | 53.00 | 53.00 |
| JBT00002436 | Ac-FQSKpNVH-Tle-DaYFERL-Eca-AKL-NH2 | 5.69 | 5.69 | 3.10 | 3.10 | | | | |
| JBT00002437 | Ac-FQSKpNVH-Tle-DaYFERL-Deg-AKL-NH2 | 5.69 | 5.69 | 15.20 | 15.20 | | | 62.90 | 62.90 |
| JBT00002438 | Ac-FQSKpNVH-Tle-DaYFERL-Aib-AKL-NH2 | 8.55 | 8.55 | 16.80 | 16.80 | 99.20 | 90.10 108.30 | 85.90 | 85.90 |
| JBT00002439 | Ac-FQSKpNV-2Ni--Tle-DaYFERL-Aib-AKL-NH2 | 8.01 | 7.03 9.00 | 13.00 | 6.40 19.60 | 88.80 | 88.80 | 51.10 | 51.10 |
| JBT00002440 | Palm-FQSKpNVH-Tle-DaYFERL-Aib-AKL-NH2 | | >500.00 | | | | | | |
| JBT00002441 | Ac-FQSKpNVH-Tle-DaYFERL[-Hcy--Aib-Ak-Hcy-]-NH2 | 55.25 | 50.25 60.25 | 1.15 | -8.10 10.40 | | | 65.50 | 65.50 |
| JBT00002442 | Ac-FQSKpNV-1Ni--Tle-DaYFERL-Aib-AKL-NH2 | 15.29 | 15.29 | -6.80 | -6.80 | | | | |

FIGURE 78S

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002443 | Ac-FQ[CKpCjVH-Tle-DaYFERL-Aib-AKL-NH2 | 237.49 | 191.11 283.87 | 2.35 | -3.70 8.40 | | | | |
| JBT00002444 | Ac-FQSKpNVH-Tle-DaYFER-Hle--Aib-AKL-NH2 | 12.54 | 12.54 | 7.40 | 7.40 | | | | |
| JBT00002445 | Ac-FQSKpN-Tle-H-Tle-DaYFER-Hle-Tle-AKL-NH2 | 129.64 | 129.64 | | | | | | |
| JBT00002446 | Ac-FQSKpNVH-Tle-DaYFERL-Aib-A-Har-L-NH2 | 57.48 | 55.65 59.31 | 2.05 | -2.30 6.40 | | | | |
| JBT00002447 | Ac-FQSKpNVH-Tle-DaYFERL-Aib-A-Opc-L-NH2 | | >500.00 | | | | | | |
| JBT00002448 | Ac-FQSKpNVH-Tle-DaYFERLA-Aib-KL-NH2 | 9.36 | 9.36 | 7.90 | 7.90 | | | | |
| JBT00002449 | Ac-FQSKpNVH-Tle-DaYFERLa-Aib-KL-NH2 | 43.23 | 35.79 50.66 | 6.80 | 6.80 | | | | |
| JBT00002450 | Ac-FQSKpNVH-Tle-DaYFl-Hcy-RLA-Hcy-]KL-NH2 | 398.31 | 190.47 413.89 590.57 | 10.05 | 4.80 15.30 | | | | |
| JBT00002451 | Ac-FQSKpEVH-Tle-DaYFERL-Aib-AKL-NH2 | 7.36 | 7.36 | 8.50 | 8.50 | | | | |
| JBT00002452 | Ac-FQSKp-Ede(O)-VH-Tle-DaYFERL-Aib-AKL-NH2 | 5.75 | 5.75 | 8.10 | 8.10 | | | | |
| JBT00002453 | Ac-FQ-Ede(O)-KpNVH-Tle-DaYFERL-Aib-AKL-NH2 | 7.90 | 7.90 | 4.40 | 4.40 | | | | |
| JBT00002458 | 374-FQSKpNVH-Tle-DaYFERL-Aib-AKL-NH2 | 6.17 | 5.36 6.98 | 9.90 | 9.90 | | | | |
| JBT00002459 | 1281-FQSKpNVH-Tle-DaYFERL-Aib-AKL-NH2 | 8.45 | 7.20 9.70 | 6.10 | 6.10 | | | | |
| JBT00002460 | 5963-FQSKpNVH-Tle-DaYFERL-Aib-AKL-NH2 | 10.90 | 9.14 12.66 | 12.40 | 12.40 | 107.60 | 107.60 | | |

FIGURE 78T

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002461 | Hex-FQSKpNVH-Tle-DaYFERL-Aib-AKL-NH2 | 4.63 | 3.20<br>4.27<br>4.28<br>4.47<br>5.26<br>5.30<br>5.63 | 10.24 | 8.10<br>9.20<br>11.20<br>11.30<br>11.40 | 97.40 | 88.00<br>90.40<br>113.80 | 39.85 | 34.30<br>45.40 |
| JBT00002462 | 4635-FQSKpNVH-Tle-DaYFERL-Aib-AKL-NH2 | 6.30 | 5.15<br>7.45 | 4.00 | 4.00 | | | | |
| JBT00002463 | 3067-FQSKpNVH-Tle-DaYFERL-Aib-AKL-NH2 | 4.15 | 3.30<br>5.00 | 9.20 | 9.20 | | | | |
| JBT00002464 | 972-FQSKpNVH-Tle-DaYFERL-Aib-AKL-NH2 | 7.72 | 6.64<br>8.79 | 10.20 | 10.20 | 104.70 | 104.70 | | |
| JBT00002465 | 973-FQSKpNVH-Tle-DaYFERL-Aib-AKL-NH2 | 6.72 | 5.51<br>7.30<br>7.34 | 15.40 | 15.40 | 107.10 | 107.10 | 52.00 | 52.00 |
| JBT00002466 | Ac-FQSKpNVH-Tle-DaYFERL-Aib-[CKL-Cea-] | 8.27 | 6.39<br>8.65<br>9.78 | 33.00 | 27.00<br>28.70<br>43.30 | 16.00 | 16.00 | | |
| JBT00002467 | Ac-FQSKpNVH-Tle-DaYFERL-Aib-[cKL-Cea-] | 6.65 | 4.18<br>5.42<br>5.82<br>6.59<br>7.22<br>7.63<br>8.16<br>8.22 | 52.90 | 44.50<br>48.70<br>56.30<br>62.10 | 12.10 | 12.10 | 34.30 | 34.30 |
| JBT00002468 | Ac-FQSKpNVH-Tle-DaYFERL[CAKL-Cea-] | 60.46 | 60.46 | | | | | | |

FIGURE 78U

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002469 | Ac-FQSKpNVH-Tle-DaYFERL[cAKL-Cea-] | 14.71 | 14.71 | 1.00 | 1.00 | | | | |
| JBT00002470 | Ac-FQSKpNVH-Tle-DaYFERL-Aib-Ak-Aml-NH2 | 19.61 | 19.61 | -4.60 | -4.60 | | | | |
| JBT00002471 | Ac-FQSKpNVH-Tle-DaYFER-Aml-AAKL-NH2 | 9.34 | 9.34 | -2.90 | -2.90 | | | | |
| JBT00002472 | Ac-FQSKpNVH-Tle-DaYFERL-Aib-LKL-NH2 | 7.59 | 7.59 | -3.90 | -3.90 | | | | |
| JBT00002473 | Ac-FQSKpNVH-Tle-DaYF-Aib-RL-Aib-LKL-NH2 | 11.92 | 11.92 | -9.50 | -9.50 | | | | |
| JBT00002474 | Ac-FQSKpNVH-Tle-DaYF-Aib-RL-Aib-AKL-NH2 | 7.27 | 7.27 | -8.90 | -8.90 | | | | |
| JBT00002475 | Ac-FQSKpNVHVPaYF-Aib-RL-Aib-AKL-NH2 | 7.66 | 7.66 | 0.80 | 0.80 | | | | |
| JBT00002476 | Ac-FQSKpNVHVPaYFERL-Aib-LKL-NH2 | 5.17 | 5.17 | -1.00 | -1.00 | | | | |
| JBT00002477 | Ac-FQSKpNVHVPaYF-Aib-RL-Aib-LKL-NH2 | 13.85 | 13.61 | 5.40 | 5.40 | | | | |
| | | | 14.09 | | | | | | |
| JBT00002478 | Ac-FQSKpNVH-Tle-Da-Dopa-FERL-Aib-AKL-NH2 | 38.36 | 38.36 | -6.10 | -6.10 | | | | |
| JBT00002479 | Ac-YQSKpNVH-Tle-DaYFERL-Aib-AKL-NH2 | 4.41 | 4.23 | 0.40 | 0.40 | | | | |
| | | | 4.60 | | | | | | |
| JBT00002480 | Ac--Dopa-QSKpNVH-Tle-DaYFERL-Aib-AKL-NH2 | 6.33 | 6.33 | 5.50 | 5.50 | | | | |
| JBT00002485 | Ac-FQSKpNV-Pmy--Tle-DaYFERL-Aib-AKL-NH2 | 5.55 | 4.85 | -0.40 | -0.40 | | | | |
| | | | 6.25 | | | | | | |
| JBT00002486 | Ac-FQSKpNTH-Tle-DaYFERL-Aib-AKL-NH2 | 8.11 | 8.11 | -2.20 | -2.20 | | | | |
| JBT00002487 | Ac-FQSKp-Cmc-VH-Tle-DaYFERL-Aib-AKL-NH2 | 9.10 | 9.10 | -2.90 | -2.90 | | | | |
| JBT00002488 | Ac-FQ-Cmc-KpNVH-Tle-DaYFERL-Aib-AKL-NH2 | 9.04 | 9.04 | -1.10 | -1.10 | | | | |
| JBT00002489 | Ac-FQSKpNVH-Tle-DaYF[-Hcy-RL-Aib-Hcy-]KL-NH2 | | >500.00 | | | | | | |
| JBT00002490 | Ac-FQSKpNVH-Tle-DaYF[cRLA-Hcy-]KL-NH2 | 6165.16 | >500.00 | | | | | | |
| | | | 6165.16 | | | | | | |
| JBT00002491 | Ac-FQSKpNVH-Tle-DaYF[CRLA-Hcy-]KL-NH2 | | >500.00 | | | | | | |
| JBT00002492 | Ac-FQSKpNVH-Tle-DaYF[cRLC]AKL-NH2 | | >500.00 | | | | | | |
| JBT00002493 | Ac-FQSKpNVH-Tle-DaYF[CRLC]AKL-NH2 | | >500.00 | | | | | | |
| JBT00002494 | Ac-FQSKpNVH-Tle-D[cYF-Hcy-]RL-Aib-AKL-NH2 | 2.84 | 2.54 | 17.60 | 13.00 | 61.50 | 61.50 | 11.10 | 11.10 |
| | | | 2.81 | | 22.20 | | | | |

FIGURE 78V

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002495 | Ac-FQSKpNVH-Tle-D[cYFC]RL-Aib-AKL-NH2 | 3.36 | 3.18<br>3.14<br>3.37<br>3.59 | 12.50 | 12.50 | 49.30 | 49.30 | | |
| JBT00002496 | Ac-FQSKpNVHVDGYFERL-Aib-AKLC(Ac-FQSKpNVHVDGYFERL-Aib-AKLK(Ttds-Maleiimidopropionyl)-NH2)--NH2 | 0.85 | 0.56<br>0.59<br>0.62<br>0.88 | 55.63 | 49.30<br>52.20<br>56.50<br>64.50 | 56.60 | 56.60 | 25.80 | 25.80 |
| JBT00002496 | Ac-FQSKpNVHVDGYFERL-Aib-AKLC(Ac-FQSKpNVHVDGYFERL-Aib-AKLK(Ttds-Maleiimidopropionyl)-NH2)--NH2 | 1.18 | 0.76<br>0.93<br>1.02<br>1.07<br>1.13<br>1.18<br>1.19<br>1.22<br>1.23<br>1.30<br>1.36<br>1.44<br>1.48 | 53.62 | 47.00<br>50.50<br>52.80<br>55.30<br>62.50 | | | 16.80 | 16.80 |
| JBT00002497 | Ac-FQSKpNVH-Tle-D-hcy-YF-Hcy-RL-Aib-AKL-NH2 | 7.16 | 7.16 | 2.50 | 2.50 | | | | |
| JBT00002498 | Ac-FQSKpNVH-Tle-D-hcy-YFCRL-Aib-AKL-NH2 | 7.59 | 7.59 | 6.00 | 6.00 | | | | |

FIGURE 78W

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002499 | Ac-FQSKpNVHVPcYF-Hcy-RL-Aib-AKL-NH2 | 3.89 | 3.30 | 17.20 | 17.20 | | | | |
| | | | 4.48 | | | | | | |
| JBT00002500 | Ac-FQSKpNVH-Tle-DcY-Bta--Hcy-RL-Aib-AKL-NH2 | 5.26 | 4.91 | 9.10 | 9.10 | 40.70 | 40.70 | | |
| | | | 5.05 | | | | | | |
| | | | 5.82 | | | | | | |
| JBT00002501 | Ac-FQSKp-C(Acm)-VH-Tle-D[cY-Bta--Hcy-]RL-Aib-AKL-NH2 | 6.31 | 5.92 | 15.10 | 15.10 | | | | |
| | | | 6.13 | | | | | | |
| | | | 6.87 | | | | | | |
| JBT00002502 | Ac-FQSKp-C(NEM)-VH-Tle-DaY-Bta-ERL-Aib-AKL-NH2 | 3.89 | 3.68 | 12.40 | 12.40 | | | | |
| | | | 4.10 | | | | | | |
| JBT00002503 | Ac-FQSKp-C(NEM)-VHVPaY-Bta-ERL-Aib-AKL-NH2 | 5.04 | 5.04 | 2.80 | 2.80 | | | | |
| JBT00002504 | Ac-FQSKpNVH-Tle-DaYFER-Ami--Aib-AKL-NH2 | 9.43 | 9.43 | -4.90 | -4.90 | | | | |
| JBT00002505 | Ac-FQSKp-Ecl-VHVPaYFERL-Aib-AKL-NH2 | 5.82 | 5.82 | -2.80 | -2.80 | | | | |
| JBT00002506 | Ac-FQSKp-Eea-VHVPaYFERL-Aib-AKL-NH2 | 6.01 | 6.01 | -2.60 | -2.60 | | | | |
| JBT00002507 | Ac-FQSKp-Eec-VHVPaYFERL-Aib-AKL-NH2 | 9.71 | 9.71 | -3.80 | -3.80 | | | | |
| JBT00002508 | Ac-FQSKp-Eef-VHVPaYFERL-Aib-AKL-NH2 | 31.05 | 31.05 | -5.20 | -5.20 | | | | |
| JBT00002509 | Ac-FQSKp-Nif-VHVPaYFERL-Aib-AKL-NH2 | 19.69 | 19.69 | -4.10 | -4.10 | | | | |
| JBT00002510 | Ac-FQSKp-Eew-VHVPaYFERL-Aib-AKL-NH2 | 8.86 | 8.86 | 2.90 | 2.90 | | | | |
| JBT00002511 | Ac-FQSKpNVH-Tle-DaY-Bta-ERL-Aib-[cKL-Cea-] | 189.24 | 183.33 | | | | | | |
| | | | 195.16 | | | | | | |
| JBT00002512 | Ac-FQSKp-C(Acm)-VH-Tle-DaY-Bta-ERL-Aib-[cKL-Cea-] | 157.63 | 134.39 | | | | | | |
| | | | 180.87 | | | | | | |
| JBT00002513 | Ac-FQSKpNVH-Tle-DaYFERL-Aib-[hcy-KL-Cea-] | 317.99 | 304.79 | | | | | | |
| | | | 331.19 | | | | | | |
| JBT00002514 | Ac-FQSKpNVH-Tle-DaYFERL-Aib-[cKL-Hcy-]-NH2 | 132.62 | 131.69 | | | | | | |
| | | | 133.55 | | | | | | |
| JBT00002515 | Ac-FQSKpNVH-Tle-DaYFERL-Aib-[cKLC]-NH2 | 579.90 | >500.00 | | | | | | |
| | | | 579.90 | | | | | | |

FIGURE 78X

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002516 | Ac-FQSKpNVH-Tle-DaYFERL-Aib-[cKLc]-NH2 | 472.87 | 402.05 543.69 | | | | | | |
| JBT00002517 | Ac-FQSKpNVHVPaY-Bta-ERL-Aib-[cKL-Cea-] | 269.09 | 228.94 309.24 | | | | | | |
| JBT00002518 | Ac-FQSKpNVHVP[cY-Bta--Hcy-]RL-Aib-AKL-NH2 | 11.56 | 10.49 11.07 12.02 12.66 | 37.50 | 24.30 50.70 | 77.70 | 77.70 | 28.30 | 28.30 |
| JBT00002519 | Ac-FQSKpNVH-Tle-DaYFERL-Aib-AKL-K(Ttds-Maleimidopropionyl)--NH2 | 5.92 | 4.79 5.92 7.06 | | | | | | |
| JBT00002520 | Ac-FQSKpNVH-Tle-DaYFERL-Aib-AKL-K(Ttds-Maleimidopropionyl(EtSH))--NH2 | 6.01 | 4.60 5.02 6.29 6.34 7.78 | | | | | | |
| JBT00002521 | (Ac-FQSKpNVHVDGYFERL-Aib-AKLC-NH2)2-M2Hex | 1.81 | 1.34 1.53 1.93 2.43 | 39.00 | 38.60 39.40 | | | | |
| JBT00002522 | (Ac-FQSKpNVHVDGYFERL-Aib-AKLC-NH2)2-M2TriO | 0.82 | 0.53 0.64 0.81 0.87 0.89 0.92 1.11 | 57.43 | 54.70 56.00 61.60 | 46.90 | 46.90 | 18.05 | 17.50 18.60 |

FIGURE 78Y

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002523 | (Ac-FQSKpNVHVDGYFERL-Aib-AKLC-NH2)2-M2PEG2000 | 1.03 | 0.92<br>0.92<br>1.05<br>1.09<br>1.17 | 61.40 | 58.00<br>59.10<br>60.60<br>67.90 | | | | |
| JBT00002527 | Ac-FQSKp-Cys(Acm)-VH-Tle-DaYFERL-Aib-AKL-NH2 | 5.43 | 5.40<br>5.46 | 2.90 | 1.60<br>3.20<br>3.90 | 86.15 | 75.90<br>96.40 | 43.00 | 38.90<br>47.10 |
| JBT00002528 | Hex-FQSKp-C(Acm)-VH-Tle-DaYFERL-Aib-AKL-NH2 | 4.78 | 3.07<br>3.34<br>4.00<br>4.06<br>4.57<br>4.73<br>5.06<br>5.37<br>5.48<br>5.80<br>5.90<br>5.99 | 12.28 | 8.20<br>10.40<br>11.20<br>13.20<br>18.40 | 90.13 | 83.80<br>83.90<br>102.70 | | |
| JBT00002531 | Hex-FQSKp-Cys(Acm)-VH-Tle-DaYFERL-Aib-AKLK(Ttds-Myr)--NH2 | 27.24 | 12.54<br>13.22<br>22.62<br>26.31<br>26.93<br>27.39<br>27.68<br>42.78 | 10.25 | 10.10<br>10.40 | 96.50 | 86.60<br>106.40 | 67.50 | 42.90<br>92.10 |

FIGURE 78Z

| Compound ID | Name | IC50 ELISA | | 24 h Koff ELISA | | 24 h Human Plasma Stability | | 24 h Mouse Plasma Stability | |
|---|---|---|---|---|---|---|---|---|---|
| | | Mean IC50 [nM] | IC50 [nM] | INHIBITION [%] | INHIBITION [%] | Mean Remaining [%] | Remaining [%] | Mean Remaining [%] | Remaining [%] |
| JBT00002531 | Hex-FQSKp-Cys(Acm)-VH-Tle-DaYFERL-Aib-AKLK(Ttds-Myr)-NH2 | 26.97 | 45.67<br>26.97 | | | | | | |
| JBT00002532 | Hex-FQSKp-Cys(Acm)-VH-Tle-DaYFERL-Aib-AKLK(Ttds-Palm)-NH2 | 36.68 | 32.09<br>35.38<br>36.51<br>39.35<br>40.08 | 13.30 | 13.20<br>13.40 | 107.70 | 107.70 | 67.50 | 67.50 |
| JBT00002533 | (Hex-FQSKp-Cys(Acm)-VH-Tle-DaYFERL-Aib-AKLC-NH2)2-M2TriO | 3.10 | 2.76<br>2.79<br>2.97<br>3.88 | 77.70 | 77.30<br>78.10 | 185.13 | 157.50<br>172.30<br>225.60 | 52.65 | 51.70<br>53.60 |
| JBT00002534 | Hex-FQSKp-Cys(Acm)-VH-Tle-DaYFERL-Aib-AKLC(ME-400MA)-NH2 | 15.32 | 13.96<br>14.46<br>15.74<br>17.12 | 13.35 | 11.80<br>14.90 | 59.83 | 46.90<br>59.70<br>60.90<br>71.80 | 69.87 | 66.50<br>69.00<br>74.10 |
| JBT00002537 | Hex-FQSKp-Cys(Acm)-VH-Tle-DaYFERL-Aib-AKLC(NEM)-NH2 | 7.13 | 4.79<br>6.41<br>6.45<br>7.59<br>10.41 | 14.40 | 9.60<br>15.70<br>17.90 | 106.65 | 88.70<br>124.60 | | |
| JBT00002539 | Hex-FQSKp-Cys(Acm)-VH-Tle-DaYFERL-Aib-AKL-Ttds-K(Ttds-Myr)-NH2 | 10.07 | 10.07 | | | | | | |
| JBT00002540 | Hex-FQSKp-Cys(Acm)-VH-Tle-DaYFERL-Aib-AKLK(Ttds-Ac)-NH2 | 3.99 | 3.99 | | | | | | |
| JBT00002541 | Hex-FQSKp-Cys(Acm)-VH-Tle-DaYFERL-Aib-AKLK(Ttds-gGlu-Myr)-NH2 | 24.34 | 24.34 | | | | | | |
| JBT00002543 | Hex-FQSKp-Cys(Acm)-VH-Tle-DaYFERL-Aib-AK-OH | 71.08 | 68.82 | | | | | | |

FIGURE 78AA

| Compound ID | Name | IC50 ELISA Mean IC50 [nM] | IC50 ELISA IC50 [nM] | 24 h Koff ELISA INHIBITION [%] | 24 h Koff ELISA INHIBITION [%] | 24 h Human Plasma Stability Mean Remaining [%] | 24 h Human Plasma Stability Remaining [%] | 24 h Mouse Plasma Stability Mean Remaining [%] | 24 h Mouse Plasma Stability Remaining [%] |
|---|---|---|---|---|---|---|---|---|---|
| JBT00002544 | (Hex-FQSKp-Cys(Acm)-VH-Tle-DaYFERL-Aib-AKLC-NH2)-Mal-mPEG23 |  | 73.35 |  |  |  |  |  |  |
|  |  | 3.61 | 3.61 |  |  | 54.00 | 54.00 | 46.20 | 46.20 |
| JBT00002546 | Hex-FQSKpSVH-Tle-DaYFERL-Aib-AKLC(NEM)-NH2 | 7.08 | 5.77 | 10.35 | 9.10 | 87.66 | 65.40 | 72.98 | 53.30 |
|  |  |  | 8.39 |  | 11.60 |  | 71.70 |  | 65.30 |
|  |  |  |  |  |  |  | 86.40 |  | 83.10 |
|  |  |  |  |  |  |  | 98.00 |  | 90.20 |
|  |  |  |  |  |  |  | 116.80 |  |  |
| JBT00002548 | Hex-FQSKpSVH-Tle-DaYFERL-Aib-AKL-NH2 | 3.62 | 2.07 |  |  | 98.85 | 85.00 | 50.25 | 45.00 |
|  |  |  | 3.83 |  |  |  | 112.70 |  | 55.50 |
|  |  |  | 3.96 |  |  |  |  |  |  |
|  |  |  | 4.63 |  |  |  |  |  |  |
| JBT00002549 | Hex-FQSKpSVH-Tle-DaYFERL-Aib-AKL-K(Myr)--NH2 | 89.96 | 89.96 |  |  |  |  |  |  |
| JBT00002550 | Hex-FQSKpSVH-Tle-DaYF-K(Myr)-RL-Aib-AKL-NH2 | 218.04 | 218.04 |  |  |  |  |  |  |
| JBT00002551 | Hex-FQSKpSVH-Tle-K(Myr)-aYFERL-Aib-AKL-NH2 |  | >500.00 |  |  |  |  |  |  |
| JBT00002552 | Hex-FQSKp-K(Myr)-VH-Tle-DaYFERL-Aib-AKL-NH2 |  | >500.00 |  |  |  |  |  |  |
| JBT00002553 | Hex-FQS-K(Myr)-pSVH-Tle-DaYFERL-Aib-AKL-NH2 |  | >500.00 |  |  |  |  |  |  |
| JBT00002554 | Hex-FQSKpSVH-Tle-DaYFERL-Aib-AKL-K(AlbuTag)-NH2 | 19.57 | 19.57 |  |  |  |  |  |  |
| JBT00002555 | Hex-FQSKpSVH-Tle-DaYFERL-Aib-AKL-K(4PBSA)-NH2 | 49.77 | 49.77 |  |  |  |  |  |  |

TFPI INHIBITORS AND METHODS OF USE

CROSS-REFERENCE TO RELATED APPLICATIONS AND INCORPORATION BY REFERENCE

This application claims the benefit of U.S. Provisional Patent Application No. 61/613,865, filed Mar. 21, 2012, which is hereby incorporated by reference in its entirety. The following applications also are incorporated by reference in their entirety: U.S. Provisional Patent Application No. 61/139,272, filed Dec. 19, 2008; U.S. patent application Ser. No. 12/643,818, filed Dec. 21, 2009; International Patent Application No. PCT/US2009/069060, filed Dec. 21, 2009; U.S. Provisional Patent Application No. 61/315,758, filed Mar. 19, 2010; U.S. patent application Ser. No. 13/026,070, filed Feb. 11, 2011; and International Patent Application No. PCT/US2011/024604, filed Feb. 11, 2011.

Incorporated by reference in its entirety is a computer-readable nucleotide/amino acid sequence listing submitted concurrently herewith and identified as follows: ASCII text file named "44241E_SeqListing.txt," 1,248,600 bytes, created Jan. 31, 2013.

TECHNICAL FIELD OF THE INVENTION

The invention generally relates to peptides that bind Tissue Factor Pathway Inhibitor (TFPI) and uses thereof.

BACKGROUND OF THE INVENTION

Hemostasis relies on the complex coagulation cascade, wherein a series of events mediated by blood clotting factors leads to conversion of prothrombin to thrombin. Factor X (FX) activation is the central event of both the intrinsic and extrinsic pathways of the coagulation cascade. The extrinsic pathway has been proposed as the primary activator of the coagulation cascade (Mackman et al., *Arterioscler. Thromb. Case. Biol.*, 27, 1687-1693 (2007)). Circulating Tissue Factor (TF) and activated Factor VII (FVIIa) interact to form the "extrinsic complex," which mediates activation of FX. The coagulation cascade is amplified by the intrinsic pathway, during which successive activation of factors XII, XI, IX, and VIII results in formation of the "intrinsic" FIXa-FVIIIa complex that also mediates FX activation. Activated FX promotes thrombin formation, which is required for the body to create fibrin and effectively curb bleeding.

Severe bleeding disorders, such as hemophilia, result from disruption of the blood coagulation cascade. Hemophilia A, the most common type of hemophilia, stems from a deficiency in factor VIII, while hemophilia B is associated with deficiencies in Factor IX (FIX). Hemophilia C is caused by a deficiency in Factor XI (FXI) (Cawthern et al., *Blood*, 91(12), 4581-4592 (1998)). There is currently no cure for hemophilia and other clotting diseases. Factor replacement therapy is the most common treatment for blood coagulation disorders. However, blood clotting factors typically are cleared from the bloodstream shortly after administration. To be effective, a patient must receive frequent intravenous infusions of plasma-derived or recombinant factor concentrates, which is uncomfortable, requires clinical settings, is expensive, and is time consuming. In addition, therapeutic efficacy of factor replacement therapy can diminish drastically upon formation of inhibitory antibodies. Approximately 30% of patients with severe hemophilia A develop inhibitory antibodies that neutralize Factor VIII (FVIII) (Peerlinck and Hermans, *Haemophilia*, 12, 579-590 (2006)). Few therapeutic options exist for patients with anti-Factor antibodies.

Thus, there exists a need in the art for compositions and methods for treating blood coagulation disorders. The invention provides such compositions and methods.

SUMMARY OF THE INVENTION

The invention includes, for example, a peptide complex comprising a first peptide and a second peptide, wherein the peptide complex comprises 30-60 amino acids. In various embodiments, two or more peptides as described herein (e.g., peptides encompassed by any of formulas (I) to (XIV)) are linked or fused to create a peptide complex (e.g., a dimer comprising two peptides (which may be the same or different), a trimer comprising three peptides (two or more of which may be the same or different), etc.). In various embodiments, the peptide complex binds to at least two different TFPI epitopes and, optionally, inhibits at least two functions of TFPI. In some embodiments, the peptide or peptide complex of the invention binds TFPI-1 (e.g., TFPI-1α) and, optionally, improves TFPI-regulated thrombin generation in the absence of FVIII, FIX, and/or FXI. A composition (e.g., a pharmaceutical composition) comprising the peptide complex also is provided.

In addition, the invention provides methods of using the peptide or peptide complex of the invention. For example, the invention provides a method of inhibiting a TFPI comprising contacting the TFPI with a peptide as described herein. The invention also provides a method of enhancing thrombin formation in a clotting factor-deficient subject, a method for increasing blood clot formation in a subject, and a method of treating a blood coagulation disorder in a subject. The methods are, in their entirety, also referred to herein as, e.g., "the method of the invention." The methods comprise administering to the subject a peptide or peptide complex as provided herein in an amount effective to achieve a desired effect, e.g., an amount effective to enhance thrombin formation, an amount effective to enhance blood clot formation, or an amount effective to treat the blood coagulation disorder in the subject. Further aspects of the invention include use of the peptide of the invention for the manufacture of a medicament, a method for targeting a cell displaying TFPI, a method for treating or diagnosing a subject suffering from a disease or at risk of suffering from a disease, a method of purifying TFPI, and a method of identifying a TFPI-binding compound. Unless explicitly indicated to the contrary, the description provided herein with respect to one peptide of the invention or method of the invention applies to each and every peptide of the invention and method of the invention, respectively. Also, unless explicitly indicated to the contrary, the description provided herein with respect to a peptide of the invention or use thereof applies to peptide complexes of the invention.

The invention also includes a TFPI inhibitor that binds human TFPI at a first binding site defined by amino acid residues F28, K29, A30, D32, I46, F47, and I55 and a second binding site defined by amino acid residues R41, Y53, C59, E60, Q63, R65, E67, E71, K74, M75, N80, N82, R83, I84, I85, T87, F96, C106, C130, L131, N133, M134, N136, F137, E142, N145, and I146. A method for identifying a TFPI-binding compound also is provided. The method comprises (a) contacting a peptide comprising TFPI Kunitz domain 1 (KD1) and Kunitz domain 2 (KD2) with a test compound, and (b) detecting binding of the test compound to a TFPI binding site defined by KD1-KD2 amino acid residues corresponding to human TFPI residues R41, Y53, C59, E60, Q63, R65, E67, E71, K74, M75, N80, N82, R83, I84, I85, T87, F96, C106, C130, L131, N133, M134, N136, F137, E142, N145, and I146.

The following numbered paragraphs each succinctly define one or more exemplary variations of the invention:

1. A peptide complex comprising a first peptide and a second peptide, wherein the peptide complex comprises 30-60 amino acids and binds to at least two different TFPI epitopes and inhibits two or more TFPI functions.

2. A peptide complex comprising a first peptide and a second peptide, wherein (a) the first peptide comprises the structure of formula (XIII): X6001-X6002-X6003-X6004-X6005-X6006-X6007-X6008-X6009-X6010-X6011-X6012-X6013-X6014-X6015-X6016-X6017-X6018-X6019-X6020 (XIII) (SEQ ID NO: 3153);

wherein X6001 is an amino acid selected from the group consisting of F, L, M, Y, 1Ni, Thi, Bta, Dopa, Bhf, C, D, G, H, I, K, N, Nmf, Q, R, T, V, and W; wherein X6002 is an amino acid selected from the group consisting of Q, G, and K; wherein X6003 is an amino acid selected from the group consisting of C, D, E, M, Q, R, S, T, Ede(O), Cmc, A, Aib, Bhs, F, G, H, I, K, L, N, P, V, W and Y; wherein X6004 is an amino acid selected from the group consisting of Aib, E, G, I, K, L, M, P, R, W, Y, A, Bhk, C, D, F, H, k, N, Nmk, Q, S, T and V; wherein X6005 is an amino acid selected from the group consisting of a, A, Aib, C, D, d, E, G, H, K, k, M, N, Nmg, p, Q, R, NpropylG, aze, pip, tic, oic, hyp, nma, Ncg, Abg, Apg, thz, dtc, Bal, F, L, S, T, V, W and Y; wherein X6006 is an amino acid selected from the group consisting of A, C, C(NEM), D, E, G, H, K, M, N, Q, R, S, V, Cit, C(Acm), Nle, I, Ede(O), Cmc, Ed, Eea, Eec, Eef, Nif, Eew, Aib, Btq, F, L, T, W and Y; wherein X6007 is an amino acid selected from the group consisting of I, V, T, Chg, Phg, Tle, A, F, G, K, L, Nmv, P, Q, S, W and Y; wherein X6008 is an amino acid selected from the group consisting of F, H, 1Ni, 2Ni, Pmy, Y, and W; wherein X6009 is an amino acid selected from the group consisting of Aib, V, Chg, Phg, Abu, Cpg, Tle, L-2-amino-4, 4,4-trifluorobutyric acid, A, f, I, K, S, and T; wherein X6010 is an amino acid selected from the group consisting of A, C, D, d, E, F, H, K, M, N, P, Q, R, S, T, V, W, Y, Nmd, C(NEM), Aib, G, I, L and Nmf; wherein X6011 is an amino acid selected from the group consisting of A, a, G, p, Sar, c, hcy, Aib, C, K, G and Nmg; wherein X6012 is an amino acid selected from the group consisting of Y, Tym, Pty, Dopa and Pmy; wherein X6013 is an amino acid selected from the group consisting of Aib, C, F, 1Ni, Thi, Bta, A, E, G, H, K, L, M, Q, R, W and Y; wherein X6014 is an amino acid selected from the group consisting of A, Aib, C, C(NEM), D, E, K, L, M, N, Q, R, T, V, Hcy, Bhe, F, G, H, I, P, S, W and Y; wherein X6015 is an amino acid selected from the group consisting of R, (omega-methyl)-R, D, E and K; wherein X6016 is an amino acid selected from the group consisting of L, Hcy, Hle and Aml; wherein X6017 is an amino acid selected from the group consisting of A, a, Aib, C, c, Cha, Dab, Eag, Eew, H, Har, Hci, Hle, I, K, L, M, Nle, Nva, Opa, Orn, R, S, Deg, Ebc, Eca, Egz, Aic, Apc, Egt, (omega-methyl)-R, Bhr, Cit, D, Dap, E, F, G, N, Q, T, V, W and Y; wherein X6018 is an amino acid selected from the group consisting of A, Aib, Hcy, hcy, C, c, L, Nle, M, N, R, Bal, D, E, F, G, H, I, K, Q, S, T, V, W and Y; wherein X6019 is an amino acid selected from the group consisting of K, R, Har, Bhk and V; and wherein X6020 is an amino acid selected from the group consisting of K, L, Hcy, Aml, Aib, Bhl, C, F, G, H, I, Nml, Q, R, S, T, V, W and Y, and (b) the second peptide comprises the structure of formula (XIV):

X7001-X7002-X7003-X7004-X7005-X7006-[X7007-X7008-X7009-X7010-X7011-X7012-X7013-X7014-X7015-X7016-X7017-X7018]-X7019-X7020-X7021-X7022-X7023 (XIV) (SEQ ID NO: 3154), wherein X7001 is either present or absent, whereby in case X7001 is present it is an amino acid selected from the group consisting of A, C, C(NEM), D, E, F, G, H, I, K, L, P, R, S, T, V and W; wherein X7002 is either present or absent, whereby in case X7002 is present it is an amino acid selected from the group consisting of A, C, C(NEM), D, E, F, G, H, I, K, L, M, P, Q, R, S, T, V, W and Y; wherein X7003 is an amino acid selected from the group consisting of A, F, I, K, L, R, S, T, V, W and Y; wherein X7004 is an amino acid selected from the group consisting of A, D, E, F, G, I, K, L, R, S, T, V and W; wherein X7005 is R or W; wherein X7006 is an amino acid selected from the group consisting of F, H, I, K, L, R, V and W; wherein X7007 is an amino acid selected from the group consisting of Orn, homoK, C, Hcy, Dap and K, preferably selected from the group consisting of C and Hcy; wherein X7008 is an amino acid selected from the group consisting of A, G, R, S and T; wherein X7009 is an amino acid selected from the group consisting of a, A, I, K, L, M, m, Moo, Nle, p, R, Sem and V; wherein X7010 is an amino acid selected from the group consisting of A, G, I, K, L, P, R, S, T and V; wherein X7011 is an amino acid selected from the group consisting of D, E, G, S and T; wherein X7012 is an amino acid selected from the group consisting of A, a, D, d, E, e, F, f, G, I, K, k, L, l, M, m, Moo, Nle, nle, P, p, R, r, S, s, Sem, T, t, V, v, W and w; wherein X7013 is an amino acid selected from the group consisting of A, C, C(NEM), Con, Con(Meox), D, d, E, e, Eag, F, G, I, K, L, N, R, S, s, T, V and W; wherein X7014 is an amino acid selected from the group consisting of A, D, E, F, G, I, K, L, M, R, S, T, V and W; wherein X7015 is an amino acid selected from the group consisting of A, D, E, F, G, I, K, L, M, Nle, R, S, T, V and W; wherein X7016 is an amino acid selected from the group consisting of A, D, E, F, I, K, L, M, Moo, Nle, R, S, Sem, T, V, W and Y; wherein X7017 is an amino acid selected from the group consisting of A, D, E, F, G, I, K, L, R, S, T, V, W and Y; wherein X7018 is an amino acid selected from the group consisting of C and D, preferably C; wherein X7019 is an amino acid selected from the group consisting of A, F, I, L, S, T, V and W; wherein X7020 is an amino acid selected from the group consisting of F and W; wherein X7021 is an amino acid selected from the group consisting of I, L and V; wherein X7022 is an amino acid selected from the group consisting of A, D, E, F, G, I, K, L, P, R, S, T, V and W; wherein X7023 is either present or absent, whereby in case X7023 is present it is an amino acid selected from the group consisting of A, C, C(NEM), Con, Con (Meox), D, E, Eag, F, G, I, K, L, R, S, T, V, W and Y; and wherein the peptide comprises as a cyclic structure generated by a linkage between X7007 and X7018.

3. The peptide complex of paragraph 2, wherein X6001 is an amino acid selected from the group consisting of 1Ni, Bta, Dopa, F, L, Y and M; wherein X6002 is Q; wherein X6003 is an amino acid selected from the group consisting of D, E, S, M, Q, R, T and C; wherein X6004 is an amino acid selected from the group consisting of K, Aib, L, P, R, E, G, I, Y, M and W; wherein X6005 is an amino acid selected from the group consisting of p, Nmg, NpropylG, aze, pip, tic, oic, hyp, a, Aib, D, d, G, H, K, k, N, Q, R, A, E, C and M; wherein X6006 is an amino acid selected from the group consisting of C, E, K, R, S, V, C(Acm), Nle, C(NEM), I, Cit, A, D, G, H, N, Q and M; wherein X6007 is an amino acid selected from the group consisting of Tle, V and I; wherein X6008 is an amino acid selected from the group consisting of H, 1Ni, 2Ni, Pmy, F and Y; wherein X6009 is V, Abu or Tle;

wherein X6010 is an amino acid selected from the group consisting of D, P, C, T, A, E, K, M, N, Q, R, F, H, S, V, W and Y; wherein X6011 is G, a, c, hcy or Sar; wherein X6012 is Y; wherein X6013 is an amino acid selected from the group consisting of F, 1Ni, Bta and C; wherein X6014 is an amino acid selected from the group consisting of Aib, C, E, Hcy, A, D, K, L, M, N, Q, R, T, V and Aib; wherein X6015 is R; wherein X6016 is an amino acid selected from the group consisting of L, Aml, Hle and Hcy; wherein X6017 is an amino acid selected from the group consisting of A, Aib, C, c, Aic, Eca, Deg, Cha, Dab, Dap, Eag, Eew, H, Har, Hci, Hle, K, Nle, Nva, Opa, Orn, R, I, L, S and M; wherein X6018 is an amino acid selected from the group consisting of A, Aib, C, c, L, Hcy, N, M and R; wherein X6019 is K; and wherein X6020 is an amino acid selected from the group consisting of L, Aml, Hcy and K.

4. The peptide complex of paragraph 2 or paragraph 3, wherein the first peptide and/or second peptide further comprises N-terminal amino acid(s) and/or moieties linked to X6001 and/or X7001 and selected from the group consisting of FAM-Ttds, PE, Palm, 2-phenyl acetyl, 3-phenyl propionyl, 2-(naphth-2-yl) acetyl, hexanoyl, 2-methyl propionyl, 3-methyl butanoyl, 2-naphthylsulfonyl, 1-naphthylsulfonyl, acetyl, Con, Con(Meox), AOA, Oxme-AOA, Meox-Lev, levulinic acid (Lev), and pentynoic acid (Pyn).

5. The peptide complex of any one of paragraphs 2-4, wherein the first peptide and/or second peptide further comprises X6021 linked to X6020 or X7024 linked to X7023, respectively, wherein X6021 and/or X7024 comprises C-terminal amino acid(s) and/or moieties selected from the group consisting of Hly, K, Orn, Dab, Eag, Dap, Hcy, Pen, C, c, C(NEM), Con, Con(Meox), K(Ttds-maleimidopropionyl (EtSH)), K(Ttds-maleimid), K(AOA), K(Myr), K(Ttds-Myr), K(Ttds-Palm), K(Ttds-Ac), K(Ttds-γGlu-Myr), K(AlbuTag), K(4PBSA), Cea, and amide.

6. The peptide complex of any one of paragraphs 2-5, wherein X7001 is an amino acid selected from the group consisting of A, D, F, G, H, K, L and S; wherein X7002 is an amino acid selected from the group consisting of H, F, M and R; wherein X7003 is an amino acid selected from the group consisting of F and Y; wherein X7004 is K; wherein X7005 is W; wherein X7006 is an amino acid selected from the group consisting of F and H; wherein X7007 is C; wherein X7008 is an amino acid selected from the group consisting of A, G and S; wherein X7009 is an amino acid selected from the group consisting of M, Sem and V; wherein X7010 is an amino acid selected from the group consisting of K, P and R; wherein X7011 is D; wherein X7012 is an amino acid selected from the group consisting of F, L, l, M and Sem; wherein X7013 is an amino acid selected from the group consisting of D, G, K and S; wherein X7014 is G; wherein X7015 is an amino acid selected from the group consisting of I and T; wherein X7016 is an amino acid selected from the group consisting of D, F, M, Sem and Y; wherein X7017 is an amino acid selected from the group consisting of S and T; wherein X7018 is C; wherein X7019 is an amino acid selected from the group consisting of A and V; wherein X7020 is W; wherein X7021 is V; wherein X7022 is an amino acid selected from the group consisting of F, L, K, R, P and W; wherein X7023 is either present or absent, whereby in case X7023 is present it is an amino acid sequence selected from the group consisting of A, D, F, M, S and Y; and wherein the peptide comprises as a cyclic structure generated by a linkage between X7007 and X7018.

7. The peptide complex of any one of paragraphs 1-6 wherein the first peptide and the second peptide is linked by linker moiety, preferably about 1-100 Å in length.

8. The peptide complex of paragraph 7, wherein the linker moiety is about 5-50 Å in length.

9. The peptide complex of paragraph 8, wherein the linker moiety is about 10-30 Å in length.

10. The peptide complex of any one of paragraphs 7-9, wherein the linker moiety comprises the structure $Z_{1-20}$, wherein Z is an amino acid, hydroxy acid, ethylene glycol, propylene glycol, or a combination of any of the foregoing.

11. The peptide complex of paragraph 10, wherein Z is G, s, S, a, A, Bal, Gaba, Ahx, Ttds, or a combination of any of the foregoing.

12. The peptide complex of any one of paragraphs 7-11, wherein the linker moiety is attached to the first peptide and/or the second peptide via an oxime, a hydrazide, a succinimide, a thioether, a triazole, a secondary amine, an amide, or a disulfide.

13. The peptide complex of any one of paragraphs 7-12, wherein the C-terminus of the first peptide is linked to the N-terminus of the second peptide via the linker moiety.

14. The peptide complex of any one of paragraphs 7-13, wherein the first peptide comprises the structure of formula (XIII), and linker moiety attaches to the first peptide at the N-terminus, at the C-terminus, or at side chains of X6001, X6004, X6006, X6010, X6014, or X6020.

15. The peptide complex of any one of paragraphs 1-14, wherein the first peptide comprises an amino acid sequence at least 80%, at least 85%, at least 90%, at least 95%, or 100% identical to SEQ ID NO: 178 or SEQ ID NO: 4261.

16. The peptide complex of any one of paragraphs 1-15, wherein the second peptide comprises an amino acid sequence at least 80%, at least 85%, at least 90%, at least 95%, or 100% identical to SEQ ID NO: 1044.

17. The peptide complex of paragraph 1 or paragraph 2 comprising the amino acid sequence set forth in SEQ ID NO: 4260.

18. The peptide complex of any one of paragraphs 1-17, wherein the peptide complex is conjugated to a polyethylene glycol (PEG) moiety, human serum albumin (HSA), an HSA-binding domain, an antibody or fragment thereof, hydroxyethyl starch, a proline-alanine-serine multimer (PASylation), a $C_{12}$-$C_{18}$ fatty acid, or polysialic acid.

19. A TFPI inhibitor that binds human TFPI at a first binding site defined by amino acid residues F28, K29, A30, D32, I46, F47, and I55 and a second binding site defined by amino acid residues R41, Y53, C59, E60, Q63, R65, E67, E71, K74, M75, N80, N82, R83, I84, I85, T87, F96, C106, C130, L131, N133, M134, N136, F137, E142, N145, and I146.

20. The TFPI inhibitor of paragraph 19, where the first binding site is defined by amino acid residues A27, F28, K29, A30, D31, D32, K36, I38, I46, F47, and I55.

21. The TFPI inhibitor of paragraph 20, where the first binding site is defined by amino acid residues A27, F28, K29, A30, D31, D32, K36, A37, I38, F44, I46, F47, and I55.

22. The TFPI inhibitor of any one of paragraphs 19-21 which is a peptide.

23. The TFPI inhibitor of any one of paragraphs 19-21, comprising a first peptide and a second peptide linked by a linker moiety.

24. The TFPI inhibitor of paragraph 23, wherein the linker moiety is about 1-100 Å in length, about 5-50 Å, or about 10-30 Å in length.

25. The TFPI inhibitor of paragraph 23 or paragraph 24, wherein the linker moiety comprises the structure $Z_{1-20}$, wherein Z is an amino acid, hydroxy acid, ethylene glycol, propylene glycol, or a combination of any of the foregoing.

26. The TFPI inhibitor of paragraph 25, wherein Z is G, s, S, a, A, Bal, Gaba, Ahx, Ttds, or a combination of any of the foregoing.

27. A peptide complex of any one of paragraphs 1-18 or a TFPI inhibitor of any one of paragraphs 19-26 for use in a method for the treatment of a subject.

28. The peptide complex or TFPI inhibitor of paragraph 27, wherein the method is for the treatment of a blood coagulation disorder.

29. Use of the peptide complex of any one of paragraphs 1-18 or the TFPI inhibitor of any one of paragraphs 19-26 for the manufacture of a medicament.

30. Use of the peptide complex of any one of paragraphs 1-18 or the TFPI inhibitor of any one of paragraphs 19-26 for the manufacture of a medicament for the treatment of a blood coagulation disorder.

31. A pharmaceutical composition comprising the peptide complex of any one of paragraphs 1-18 or the TFPI inhibitor of any one of paragraphs 19-26 and a pharmaceutically acceptable carrier.

32. The pharmaceutical composition of paragraph 31, wherein the composition comprises a further pharmaceutically effective agent.

33. The pharmaceutical composition of paragraph 31, wherein the pharmaceutical composition is for use in a method of treating a blood coagulation disorder.

34. A method for treating a subject suffering from a disease or being at risk of suffering from a disease, the method comprising administering to the subject a pharmaceutical composition of paragraph 31.

35. The method of paragraph 34, wherein the disease is a blood coagulation disorder.

36. A method for identifying a TFPI-binding compound, the method comprising (a) contacting a peptide comprising TFPI Kunitz domain 1 (KD1) and Kunitz domain 2 (KD2) with a test compound, and (b) detecting binding of the test compound to a TFPI binding site defined by KD1-KD2 amino acid residues corresponding to human TFPI residues R41, Y53, C59, E60, Q63, R65, E67, E71, K74, M75, N80, N82, R83, I84, I85, T87, F96, C106, C130, L131, N133, M134, N136, F137, E142, N145, and I146.

37. The method of paragraph 36, wherein step (b) further comprises detecting binding of the test compound to a TFPI binding site defined by KD1 amino acid residues corresponding to human TFPI residues F28, K29, A30, D32, I46, F47, and I55.

38. The method of paragraph 37, wherein the TFPI binding site is defined by KD1 amino acid residues corresponding to human TFPI residues F28, K29, A30, D32, I46, F47, I55A27, D31, K36, A37, I38, F44, and I46.

39. A peptide consisting of the amino acid sequence selected from the group consisting of SEQ ID NOs: 1337-1355 and 4240-4268.

40. A method for inhibiting degradation of TFPI by a serine protease, the method comprising contacting TFPI with a peptide comprising the structure of formula (XIV):

X7001-X7002-X7003-X7004-X7005-X7006-[X7007-X7008-X7009-X7010-X7011-X7012-X7013-X7014-X7015-X7016-X7017-X7018]-X7019-X7020-X7021-X7022-X7023 (XIV) (SEQ ID NO: 3154), wherein X7001 is either present or absent, whereby in case X7001 is present it is an amino acid selected from the group consisting of A, C, C(NEM), D, E, F, G, H, I, K, L, P, R, S, T, V and W; wherein X7002 is either present or absent, whereby in case X7002 is present it is an amino acid selected from the group consisting of A, C, C(NEM), D, E, F, G, H, I, K, L, M, P, Q, R, S, T, V, W and Y; wherein X7003 is an amino acid selected from the group consisting of A, F, I, K, L, R, S, T, V, W and Y; wherein X7004 is an amino acid selected from the group consisting of A, D, E, F, G, I, K, L, R, S, T, V and W; wherein X7005 is R or W; wherein X7006 is an amino acid selected from the group consisting of F, H, I, K, L, R, V and W; wherein X7007 is an amino acid selected from the group consisting of Orn, homoK, C, Hcy, Dap and K, preferably selected from the group consisting of C and Hcy; wherein X7008 is an amino acid selected from the group consisting of A, G, R, S and T; wherein X7009 is an amino acid selected from the group consisting of a, A, I, K, L, M, m, Moo, Nle, p, R, Sem and V; wherein X7010 is an amino acid selected from the group consisting of A, G, I, K, L, P, R, S, T and V; wherein X7011 is an amino acid selected from the group consisting of D, E, G, S and T; wherein X7012 is an amino acid selected from the group consisting of A, a, D, d, E, e, F, f, G, I, K, k, L, l, M, m, Moo, Nle, nle, P, p, R, r, S, s, Sem, T, t, V, v, W and w; wherein X7013 is an amino acid selected from the group consisting of A, C, C(NEM), Con, Con(Meox), D, d, E, e, Eag, F, G, I, K, L, N, R, S, s, T, V and W; wherein X7014 is an amino acid selected from the group consisting of A, D, E, F, G, I, K, L, M, R, S, T, V and W; wherein X7015 is an amino acid selected from the group consisting of A, D, E, F, G, I, K, L, M, Nle, R, S, T, V and W; wherein X7016 is an amino acid selected from the group consisting of A, D, E, F, I, K, L, M, Moo, Nle, R, S, Sem, T, V, W and Y; wherein X7017 is an amino acid selected from the group consisting of A, D, E, F, G, I, K, L, R, S, T, V, W and Y; wherein X7018 is an amino acid selected from the group consisting of C and D, preferably C; wherein X7019 is an amino acid selected from the group consisting of A, F, I, L, S, T, V and W; wherein X7020 is an amino acid selected from the group consisting of F and W; wherein X7021 is an amino acid selected from the group consisting of I, L and V; wherein X7022 is an amino acid selected from the group consisting of A, D, E, F, G, I, K, L, P, R, S, T, V and W; wherein X7023 is either present or absent, whereby in case X7023 is present it is an amino acid selected from the group consisting of A, C, C(NEM), Con, Con (Meox), D, E, Eag, F, G, I, K, L, R, S, T, V, W and Y; and wherein the peptide comprises as a cyclic structure generated by a linkage between X7007 and X7018, whereby degradation of TFPI by the serine protease is inhibited.

41. The method of paragraph 40, wherein X7001 is an amino acid selected from the group consisting of A, D, F, G, H, K, L and S; wherein X7002 is an amino acid selected from the group consisting of H, F, M and R; wherein X7003 is an amino acid selected from the group consisting of F and Y; wherein X7004 is K; wherein X7005 is W; wherein X7006 is an amino acid selected from the group consisting of F and H; wherein X7007 is C; wherein X7008 is an amino acid selected from the group consisting of A, G and S; wherein X7009 is an amino acid selected from the group consisting of M, Sem and V; wherein X7010 is an amino acid selected from the group consisting of K, P and R; wherein X7011 is D; wherein X7012 is an amino acid selected from the group consisting of F, L, l, M and Sem; wherein X7013 is an amino acid selected from the group consisting of D, G, K and S; wherein X7014 is G; wherein X7015 is an amino acid selected from the group consisting of I and T; wherein X7016 is an amino acid selected from the group consisting of D, F, M, Sem and Y; wherein X7017 is an amino acid selected from the group consisting of S and T; wherein X7018 is C; wherein X7019 is an amino acid selected from the group consisting of A and V; wherein X7020 is W; wherein X7021 is V; wherein X7022 is an amino acid selected from the group consisting of F, L, K, R, P and W; wherein X7023 is either present or absent, whereby in case X7023 is present it is an amino acid sequence selected from the group consisting of A, D, F, M, S and Y; and wherein the peptide comprises as a cyclic structure generated by a linkage between X7007 and X7018.

42. The method of paragraph 40 or paragraph 41, wherein the peptide is part of a peptide complex that further comprises a peptide comprising the structure of formula (XIII):
X6001-X6002-X6003-X6004-X6005-X6006-X6007-X6008-X6009-X6010-X6011-X6012-X6013-X6014-X6015-X6016-X6017-X6018-X6019-X6020 (XIII) (SEQ ID NO: 3153);

wherein X6001 is an amino acid selected from the group consisting of F, L, M, Y, 1Ni, Thi, Bta, Dopa, Bhf, C, D, G, H, I, K, N, Nmf, Q, R, T, V, and W; wherein X6002 is an amino acid selected from the group consisting of Q, G, and K; wherein X6003 is an amino acid selected from the group consisting of C, D, E, M, Q, R, S, T, Ede(O), Cmc, A, Aib, Bhs, F, G, H, I, K, L, N, P, V, W and Y; wherein X6004 is an amino acid selected from the group consisting of Aib, E, G, I, K, L, M, P, R, W, Y, A, Bhk, C, D, F, H, k, N, Nmk, Q, S, T and V; wherein X6005 is an amino acid selected from the group consisting of a, A, Aib, C, D, d, E, G, H, K, k, M, N, Nmg, p, Q, R, NpropylG, aze, pip, tic, oic, hyp, nma, Ncg, Abg, Apg, thz, dtc, Bal, F, L, S, T, V, W and Y; wherein X6006 is an amino acid selected from the group consisting of A, C, C(NEM), D, E, G, H, K, M, N, Q, R, S, V, Cit, C(Acm), Nle, I, Ede(O), Cmc, Ed, Eea, Eec, Eef, Nif, Eew, Aib, Btq, F, I, L, T, W and Y; wherein X6007 is an amino acid selected from the group consisting of I, V, T, Chg, Phg, Tle, A, F, G, I, K, L, Nmv, P, Q, S, W and Y; wherein X6008 is an amino acid selected from the group consisting of F, H, 1Ni, 2Ni, Pmy, Y, and W; wherein X6009 is an amino acid selected from the group consisting of Aib, V, Chg, Phg, Abu, Cpg, Tle, L-2-amino-4,4,4-trifluorobutyric acid, A, f, I, K, S, T and V; wherein X6010 is an amino acid selected from the group consisting of A, C, D, d, E, F, H, K, M, N, P, Q, R, S, T, V, W, Y, Nmd, C(NEM), Aib, G, I, L and Nmf; wherein X6011 is an amino acid selected from the group consisting of A, a, G, p, Sar, c, hcy, Aib, C, K, G and Nmg; wherein X6012 is an amino acid selected from the group consisting of Y, Tym, Pty, Dopa and Pmy; wherein X6013 is an amino acid selected from the group consisting of Aib, C, F, 1Ni, Thi, Bta, A, E, G, H, K, L, M, Q, R, W and Y; wherein X6014 is an amino acid selected from the group consisting of A, Aib, C, C(NEM), D, E, K, L, M, N, Q, R, T, V, Hcy, Bhe, F, G, H, I, P, S, W and Y; wherein X6015 is an amino acid selected from the group consisting of R, (omega-methyl)-R, D, E and K; wherein X6016 is an amino acid selected from the group consisting of L, Hcy, Hle and Aml; wherein X6017 is an amino acid selected from the group consisting of A, a, Aib, C, c, Cha, Dab, Eag, Eew, H, Har, Hci, Hle, I, K, L, M, Nle, Nva, Opa, Orn, R, S, Deg, Ebc, Eca, Egz, Aic, Apc, Egt, (omega-methyl)-R, Bhr, Cit, D, Dap, E, F, G, N, Q, T, V, W and Y; wherein X6018 is an amino acid selected from the group consisting of A, Aib, Hcy, hcy, C, c, L, Nle, M, N, R, Bal, D, E, F, G, H, I, K, Q, S, T, V, W and Y; wherein X6019 is an amino acid selected from the group consisting of K, R, Har, Bhk and V; and wherein X6020 is an amino acid selected from the group consisting of K, L, Hcy, Aml, Aib, Bhl, C, F, G, H, I, Nml, Q, R, S, T, V, W and Y.

43. The method of any one of paragraphs 40-43, wherein the protease is elastase, thrombin, plasmin, FXa, or chymase.

DESCRIPTION OF THE FIGURES

FIG. 4 is a listing of amino acid sequences of various TFPI-binding peptides (e.g., TFPI-inhibitory peptides) denoting amino acid substitutions (bolded and underlined) in reference to peptide JBT0293.

FIGS. 10A and 10B are sensorgrams plotting RU (y-axis) against time in seconds (x-axis) for peptide JBT0120 interaction with Tissue Factor Pathway Inhibitor-1 and Tissue Factor Pathway Inhibitor-2.

FIGS. 12A-12O, 13A-13D, 14A-14E, 15A-15D, 16A-16F, 17A-17B, and 18A-18E are tables listing the amino acid sequences of various TFPI-binding peptides; $EC_{50}$ and percent inhibition of TFPI observed in the FXa inhibition assay; $EC_{50}$ and percent inhibition of TFPI observed in the extrinsic tenase inhibition assay; and FEIBA, Factor VIII (FVIII) Immunate, or Factor IX (FIX) equivalent activities (mU/mL) in plasma-based assays. "*" denotes negative controls.

FIGS. 19A-19B, 20, and 21 are tables listing the results from BIAcore analysis of several TFPI-binding peptides. "*" denotes negative controls.

FIGS. 22A-22L, 23A-23K, 24A-24C, 25A-25L, 26A-26F, 27A-27C, 28A-28L, 29A-29F, and 30A-30D are tables listing the amino acid sequences of various TFPI-binding peptides; $EC_{50}$ and percent inhibition of TFPI observed in the FXa inhibition assay; $EC_{50}$ and percent inhibition of TFPI observed in the extrinsic tenase inhibition assay; and FEIBA, FVIII Immunate, or FIX equivalent activities (mU/mL) in plasma-based assays. "*" denotes negative controls.

FIGS. 32A-32AM, 33, 34A-34J, 35, 36A-36Q, 37, 38A-38B, and 39 are tables listing the amino acid sequences and $IC_{50}$ or $EC_{50}$ values of various peptides of the invention. "*" denotes negative controls.

FIG. 47 is a table listing assignments for the carbonyl carbon (C), the alpha carbon (CA), the beta carbon (CB), the amide proton (H), and the amide nitrogen (N) of JBT0788 based on HSQC, HNCACB, HNCA, HNCO and HNN spectra.

FIG. 49 is a table listing assignments for the carbonyl carbon (C), the alpha carbon (CA), the beta carbon (CB), the amide proton (H), and the amide nitrogen (N) of JBT0788 complexed with TFPI160 based on HSQC, HNCACB, HNCA, HCCOCA, and HNCO spectra.

FIG. 51 is a table listing assignments for the carbonyl carbon (C), the alpha carbon (CA), the beta carbon (CB), the amide proton (H), and the amide nitrogen (N) of JBT0616 based on HSQC, HNCACB, and HNN spectra.

FIG. 53 is a table listing assignments for the carbonyl carbon (C), the alpha carbon (CA), the beta carbon (CB), the amide proton (H), and the amide nitrogen (N) of JBT0616 complexed with TFPI based on HSQC, HNCO, HNCA, and HNCOCA spectra.

FIG. 62A-62F is a table listing the amino acid sequences and $IC_{50}$ or $EC_{50}$ values of various peptides of the invention. Designation "n.a." is "not analyzed." Progression curve data were obtained using the FXa inhibition assay described in Example 3 with recombinant human full length TFPI. Assay concentration of progression curve assay was 0.0025% (0.1% Tween80 used in peptide dilution buffer).

FIG. 65A-65B is a table listing the amino acid sequences of various peptides of the invention.

FIGS. 68A-68D are graphs correlating concentration of JBT1837 (triangles; SEQ ID NO: 1044), JBT1857 (circles; SEQ ID NO: 178), JBT2547 (diamonds; SEQ ID NO: 4260), and JBT1837+JBT1857 (squares) (μM) (X-axis) with percent inhibition of TFPI in a FXa inhibition assay performed with 0.5 nM full length human TFPI (FIG. 68A), 0.5 nM human TFPI 1-160 (FIG. 68B), 0.5 nM murine TFPI 1-160 (FIG. 68C), or 0.5 nM cynomologus money TFPI 1-160 (FIG. 68D). FIG. 68E illustrates TFPI inhibition by JBT2547 at increasing TFPI concentrations (0.1 to 10 nM from left to right) in a FXa inhibition assay. Data points were fitted by a sigmoidal dose response equation resulting in $EC_{50}$s (nM) and maximal inhibition (%). FIG. 68F is a graph correlating TFPI inhibition (%) by JBT2547 (diamonds), JBT2548 (circles), JBT1837 (triangles) and a combination of JBT1837 and JBT1857 (squares) (1 μM peptide) in the presence of increasing full length human TFPI concentrations.

FIG. 69 illustrates the results of extrinsic tenase inhibition assays using a TFPI-binding peptide complex.

FIG. 73 is a chart listing non-limiting examples of nucleophilic or electrophilic reactive groups for peptide linkage.

FIG. 74 is a sequence alignment of TFPI KD1-KD2 from different species. Residues with a contact surface of 10-25 $Å^2$=41, 56, 59, 60, 67, 71, 74, 96, 106, 130, 132, 133, 136, 137, 142; residues with a contact surface of 26-60 $Å^2$=75, 80, 82, 84, 85, 87, 145; residues with a contact surface of 61-100 $Å^2$=63, 65, 131, 146; residues with a contact surface of greater than 100 $Å^2$=83, 134.

FIG. 76A-76D is a table listing the amino acid sequences of various peptides of the invention.

FIG. 77 is a table listing the amino acid sequences of various peptides of the invention.

FIGS. 78A-78AA is a table listing the amino acid sequences of various peptides of the invention.

DETAILED DESCRIPTION OF THE INVENTION

Figure 1:
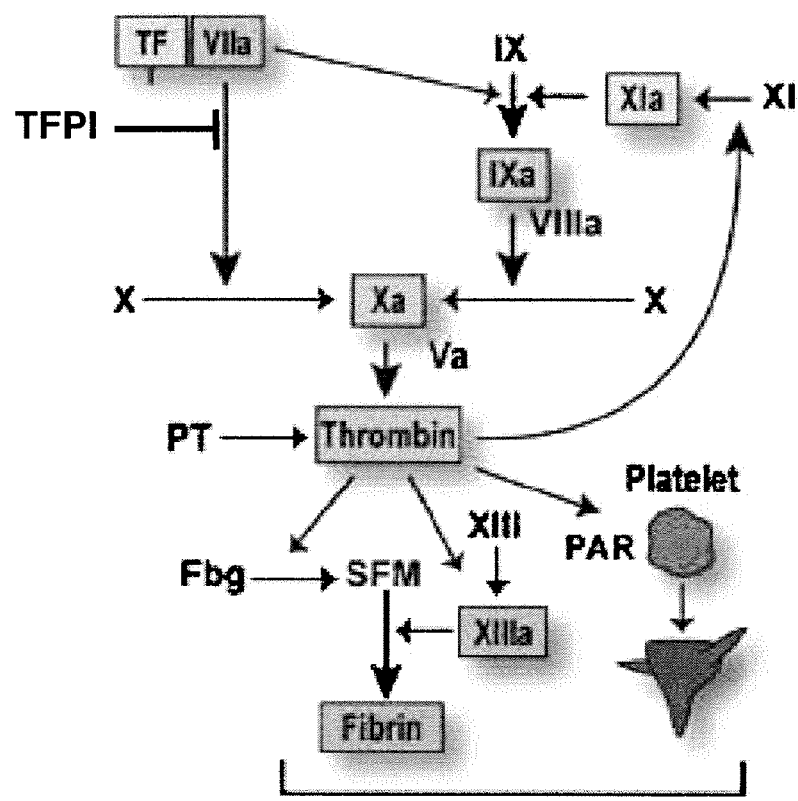
FIG. 1 is an illustration of the blood coagulation cascade.
Figure 2:
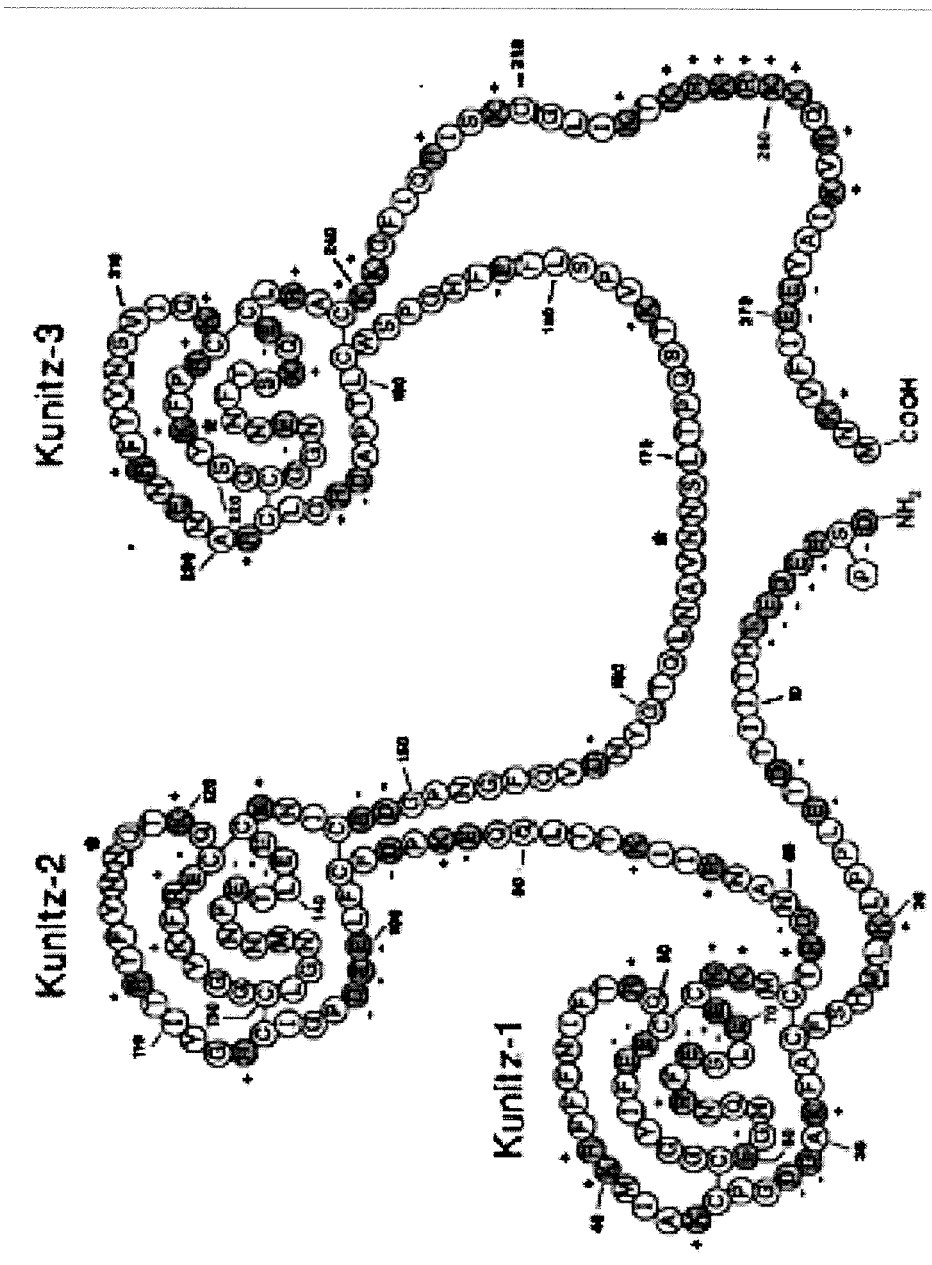
FIG. 2 is an illustration of the secondary structure of Tissue Factor Pathway Inhibitor-1.
Figure 3:
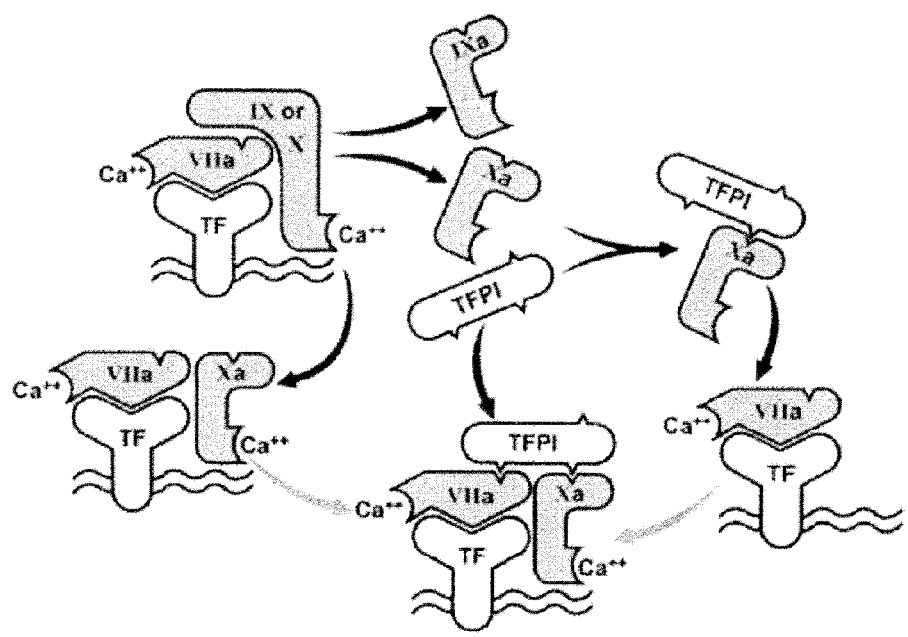
FIG. 3 is an illustration of the formation of a quaternary complex comprising Tissue Factor, Factor Xa (FXa), Factor VIIa (FVIIa), and TFPI.

The invention provides peptides and peptide complexes. In various embodiments, the peptide or peptide complex binds Tissue Factor Pathway Inhibitor-1 and, in some instances, blocks the inhibitory activity of Tissue Factor Pathway Inhibitor-1 (herein referred to as TFPI) within the blood coagulation cascade. Upon vascular injury, Tissue Factor (TF) complexes with Factor VIIa to form the "extrinsic complex" or "extrinsic tenase complex," which activates Factors IX and X (FIG. 1). TFPI is the main natural regulator of TF/FVIIa extrinsic complex activity and by extension, plays a role in controlling thrombin generation (Panteleev et al., *Eur. J. Biochem.*, 249, 2016-2031 (2002)). TFPI is a 43 kDa serine protease inhibitor comprising three Kunitz-type inhibitory domains (FIG. 2). Kunitz domain 1 of TFPI binds FVIIa and Kunitz domain 2 binds FXa, enabling the inhibitor to form a quaternary FXa-TFPI-FVIIa-TF complex that blocks activity of the TF/FVIIa extrinsic complex (FIG. 3). TFPI binding of FXa also downregulates the common pathway of the coagulation cascade, during which FXa converts prothrombin to thrombin (Audu et al., *Anesth. Analg.*, 103(4), 841-845 (2006)). The invention provides, e.g., TFPI-inhibitory peptides that block TFPI's inhibitory action on the blood coagulation cascade, thereby enhancing thrombin formation. In the context of the disclosure, any peptide encompassed by any of formulas (I) to (XIV) described herein and any TFPI-binding peptide described herein is also referred to as "the peptide of the invention" and as "a peptide as described herein."

The amino acid sequences of several TFPI-binding peptides are provided herein. Conventional amino acids are identified according to their standard, one-letter or three-letter codes, as set forth in Table 1.

TABLE 1

| 3-letter codes | 1-letter code | Amino acids |
| --- | --- | --- |
| Ala | A | Alanine |
| Cys | C | Cysteine |
| Asp | D | Aspartic acid |
| Glu | E | Glutamic acid |
| Phe | F | Phenylalanine |
| Gly | G | Glycine |
| His | H | Histidine |
| Ile | I | Isoleucine |
| Lys | K | Lysine |
| Leu | L | Leucine |
| Met | M | Methionine |
| Asn | N | Asparagine |
| Pro | P | Proline |
| Gln | Q | Glutamine |
| Arg | R | Arginine |
| Ser | S | Serine |
| Thr | T | Threonine |
| Val | V | Valine |
| Trp | W | Tryptophan |
| Tyr | Y | Tyrosine |

Examples of non-conventional amino acids and additional peptide building blocks are identified according to a three-letter code (with the exception of Ttds and Dopa, which are common four-letter abbreviations) found in Table 2. Additional building blocks designated by three-, four- or seven-number/letter designations or abbreviations also are listed in Table 2. The structures of some building blocks are depicted with an exemplary reagent for introducing the building block into a peptide (e.g., the structure provided for 2-naphthyl sulfonyl comprises a chloride).

TABLE 2

| Name | Abbreviation | Structure |
|---|---|---|
| Phenyl acetyl | 374 | PhCH₂COOH (374) |
| 2-Naphthyl sulfonyl | 972 | 2-Naphthyl-SO₂Cl (972) |
| 1-Naphthyl sulfonyl | 973 | 1-Naphthyl-SO₂Cl (973) |
| 3-Phenyl propionyl | 1281 | PhCH₂CH₂COOH (1281) |
| Hexanoyl | 1525 | CH₃(CH₂)₄COOH (1525) |

TABLE 2-continued

| Name | Abbreviation | Structure |
|---|---|---|
| 3-Methyl butanoyl | 3067 | 3067 |
| 2-Methyl propionyl | 4635 | 4635 |
| 2-(Naphth-2-yl) acetyl | 5963 | 5963 |
| N-(4-aminobutyl)-glycine | Abg | 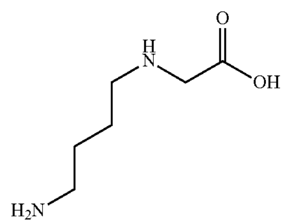 |
| 2-aminobutyric acid | Abu | 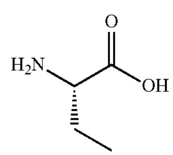 |
| 2-Amino-isobutyric acid | Aib | 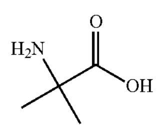 |

TABLE 2-continued
| Name | Abbreviation | Structure |
|---|---|---|
| 2-Aminoindane-2-carboxylic acid | Aic | 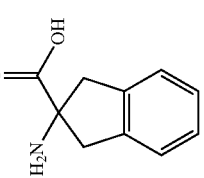 |
| L-alpha-Methyl leucine | Aml | 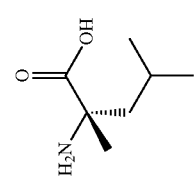 |
| Aminooxyacetic acid | AOA | 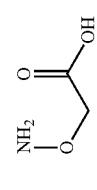 |
| 1-Amino-(4-N-piperidinyl)carboxylic acid | Apc | 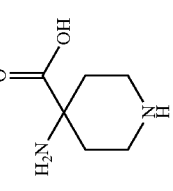 |
| N-(4-aminopropyl)-glycine | Apg | 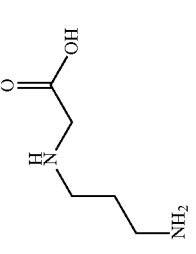 |

TABLE 2-continued
| Name | Abbreviation | Structure |
|---|---|---|
| D-Azetidine-2-carboxylic acid | aze | 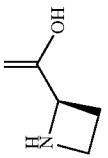 |
| β-Alanine | Bal | 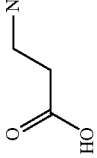 |
| β-Homoglutamatic acid | Bhe | 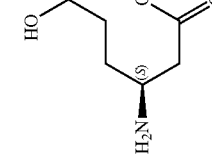 |
| β-Homophenylalanine | Bhf | 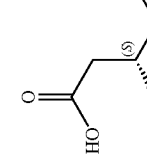 |
| β-Homolysine | Bhk | 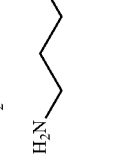 |
| β-Homoleucine | Bhl | 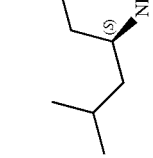 |

TABLE 2-continued

| Name | Abbreviation | Structure |
|---|---|---|
| β-Homoasparagine | Bhn | 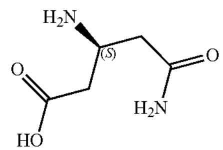 |
| β-Homoglutamine | Bhq | 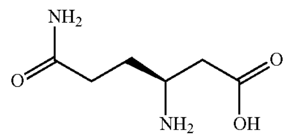 |
| β-Homoarginine | Bhr | 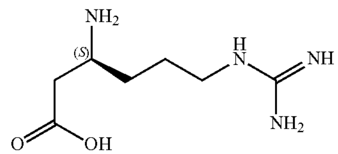 |
| β-Homoserine | Bhs | 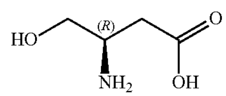 |
| β-Homotyrosine | Bhy | 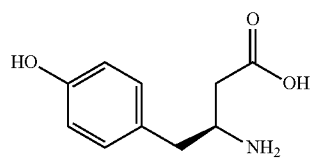 |
| β-Homoaspartic acid | Bhd | 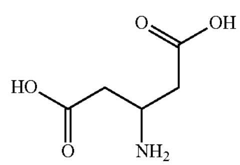 |
| β-Homovaline | Bhv, Btl | 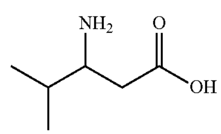 |

TABLE 2-continued

| Name | Abbreviation | Structure |
|---|---|---|
| β-Homoasparagin | Bhn, Btq | (structure) |
| L-3-Benzothienylalanine | Bta | (structure) |
| 3-(Acetylamino-methylsulfanyl)-2-amino-propionic acid | C(Acm) | (structure) |
| Aminoethylthiol | Cea | (structure) |

TABLE 2-continued

| Name | Abbreviation | Structure |
|---|---|---|
| (S)-Cyclohexylalanine | Cha | (structure) |
| L-Cyclohexylglycine | Chg | (structure) |
| (S)-Citrullin | Cit | (structure) |
| Carboxymethylen cystein | Cmc | (structure) |

TABLE 2-continued

| Name | Abbreviation | Structure |
|---|---|---|
| N-ethylmaleiimido cysteine | C(NEM) | 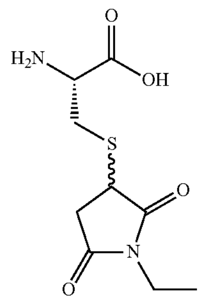 [SMILES: CCN1C(=O)CC(SC[C@H](N)C(=O)O)C1=O] |
| 8-amino-1,4-dioxa-spiro[4,5]decane-8-carboxylic acid | Con | 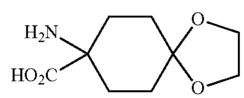 |
| 1-Amino-(4-methoximino)-cyclohexane-1-carboxlic acid | Con(Meox) | 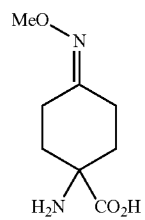 |
| L-Cyclopentylglycine | Cpg | 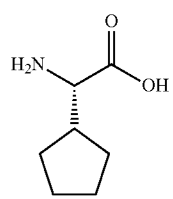 |
| (S)-2,4-Diaminobutyric acid | Dab | 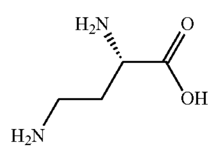 |

TABLE 2-continued
| Name | Abbreviation | Structure |
|---|---|---|
| (S)-Diaminopropionic acid | Dap | 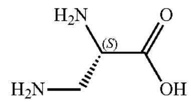 |
| alpha,alpha-Diethylglycine | Deg | 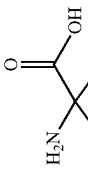 |
| 5,5-Dimethyl-D-thiazolidine-4-carboxylic acid | dtc | 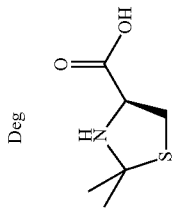 |
| 3,4-Dihydroxy-phenylalanine | Dopa | 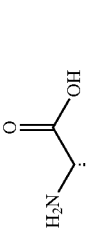 |
| (S)-2-Propargylglycine | Eag | 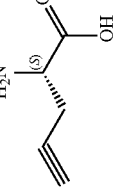 |
| 1-Amino-cyclopropane-1-carboxylic acid | Ebc | 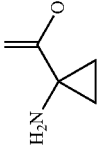 |

TABLE 2-continued

| Name | Abbreviation | Structure |
|---|---|---|
| 1-Amino-cyclopentane-1-carboxylic acid | Eca | (structure) |
| Cys(3-propionic acid amide) | Ecl | (structure) |
| Sulfoxid of Carboxyethylcystein | Ede(O) | (structure) |

TABLE 2-continued

| Name | Abbreviation | Structure |
|---|---|---|
| Cys(5-methylen-2-oxazolidinon) | Eea | 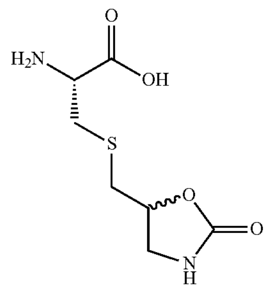 |
| Cys(1-methylen-1H-benzotriazol) | Eec | 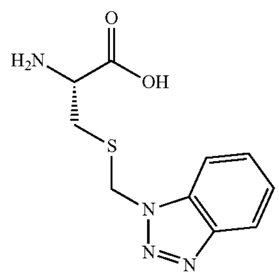 |
| Cys(3-methylen-2-benzothiazolinon) | Eef | 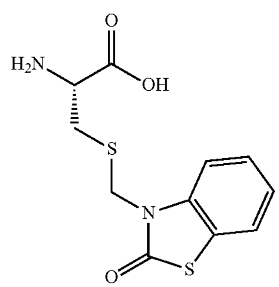 |

TABLE 2-continued

| Name | Abbreviation | Structure |
|---|---|---|
| (S)-N(omega)-nitro-arginine | Eew | 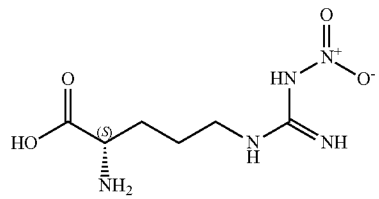 |
| alpha,alpha-Dibutylglycine | Egt | 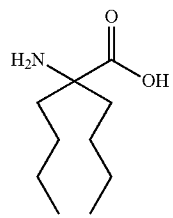 |
| 1-amino-cyclohexane-1-carboxylic acid | Egz | 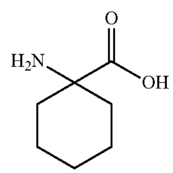 |
| L-homophenylalanine | Hfe | 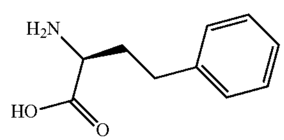 [SMILES: N[C@@H](CCc1ccccc1)C(=O)O] |
| (S)-Homo-arginine | Har | 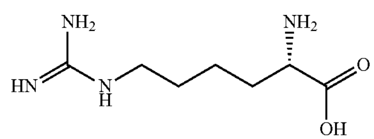 [SMILES: N=C(N)NCCCC[C@H](N)C(=O)O] |
| (S)-Homo-citrulline | Hci | 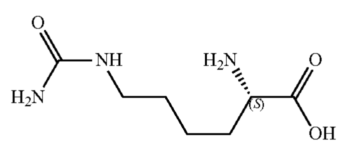 |

TABLE 2-continued

| Name | Abbreviation | Structure |
|---|---|---|
| (S)-Homo-cysteine | Hcy | 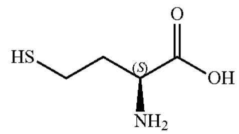 |
| D-Homo-cysteine | hcy | 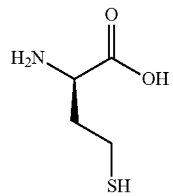 |
| (S)-2-Amino-5-methyl-hexanoic acid | Hle | 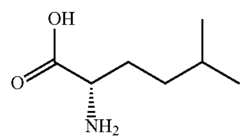 |
| (S)-Homo-lysine | Hly | 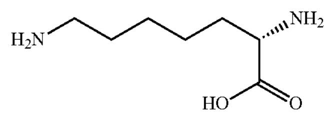 [SMILES: NCCCCC[C@H](N)C(=O)O] |
| ε-(Acetyl)-L-lysine | K(Ac) | |
| ε-(4-(p-Iodophenyl)butyryl)-L-lysine | K(AlbuTag) | |

TABLE 2-continued

| Name | Abbreviation | Structure |
|---|---|---|
| 2-Amino-6-(2-aminooxy-acetylamino)-hexanoic acid | K(AOA) | |
| ε-(Myristyl)-L-lysine | K(Myr) | |
| ε-(Acetyl-Ttds)-L-lysine | K(TtdsAc) | |
| ε-(Myristyl-Ttds)-L-lysine | K(TtdsMyr) | |
| ε-(Myristyl-γ-glutamyl-Ttds)-L-lysine | K(Ttds-γGlu-Myr) | |
| ε-(Palmityl-Ttds)-L-lysine | K(TtdsPal) | |
| ε-(4-(Pentyl)-benzolsulfonamidyl)-L-lysine | K(4PBSA) | |

TABLE 2-continued

| Name | Abbreviation | Structure |
|---|---|---|
| 4-Methoxyimino-pentanoic acid | Meox-Lev | (structure) |
| L-methionine-sulphone | | (structure) |
| 1-Naphthylalanine | 1Ni | (structure) |
| 2-Naphthylalanine | 2Ni | (structure) |

TABLE 2-continued

| Name | Abbreviation | Structure |
|---|---|---|
| N-(cyclohexyl)-glycine | Ncg | (cyclohexyl-NH-CH2-COOH) |
| 4-Nitrophenyl alanine | Nif | (H2N-CH(COOH)-CH2-C6H4-NO2) |
| (S)-Norleucine | Nle | (butyl-CH(NH2)-COOH) |
| (S)-N-Methylalanine | Nma | (CH3-NH-CH(CH3)-COOH) |
| (S)-N-Methyl-Aspartic acid | Nmd | (HOOC-CH2-CH(NHCH3)-COOH) |
| (S)-N-Methyl-glutamic acid | Nme | (HOOC-CH(NHCH3)-CH2-CH2-COOH) |

TABLE 2-continued

| Name | Abbreviation | Structure |
|---|---|---|
| (S)-N-Methyl-phenylalanine | Nmf | 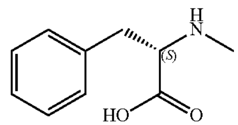 |
| N-Methyl-glycine | Nmg | 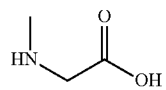 |
| (S)-N-Methyl-lysine | Nmk | 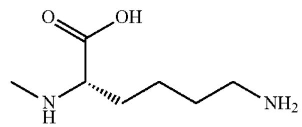 |
| (S)-N-Methyl-leucine | Nml | 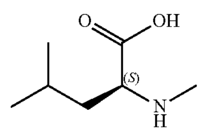 |
| N-Methyl-asparagine | Nmn | 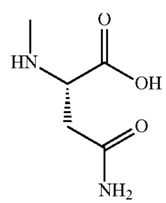 |
| (S)-N-Methyl-arginine | Nmr | 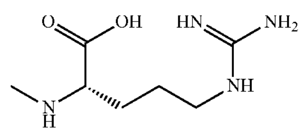 |
| (S)-N-Methyl-serine | Nms | 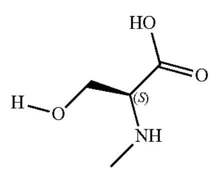 |

TABLE 2-continued

| Name | Abbreviation | Structure |
|---|---|---|
| (S)-N-Methyl-valine | Nmv | 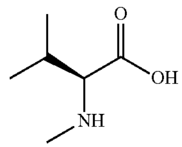 |
| (S)-N-Methyl-tyrosine | Nmy | 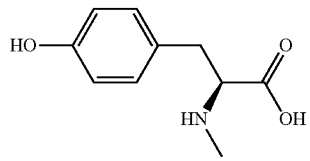 |
| N-propyl glycine | NpropylG | 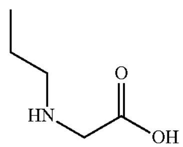 |
| (S)-2-Amino-pentanoic acid | Nva | 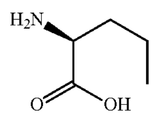 |
| (S)-2-Pyridyl-alanine | Opa | 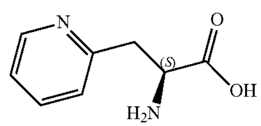 |

TABLE 2-continued
| Name | Abbreviation | Structure |
|---|---|---|
| Ornithine-(pyrazin-carboxylate) | Opc | 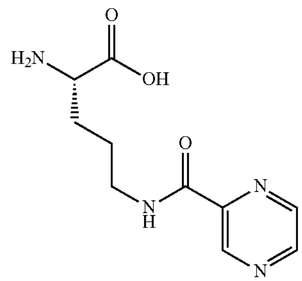 |
| D-Octahydroindol-2-carboxylic acid | oic | 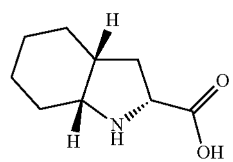 [SMILES: O=C(O)[C@H]1C[C@H]2CCCC[C@H]2N1] |
| (S)-Ornithine | Orn | 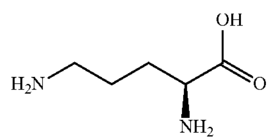 |
| Ethylidene-aminooxy-acetic acid | Oxme-AOA | 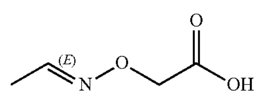 |
| Palmitoyl | Palm | 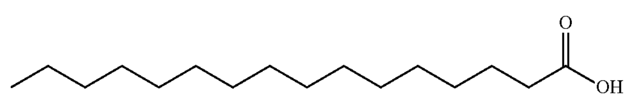 |
| L-Phenylglycin | Phg | 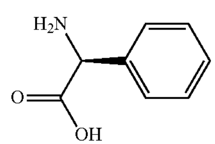 [SMILES: N[C@H](C(=O)O)c1ccccc1] |

TABLE 2-continued

| Name | Abbreviation | Structure |
|---|---|---|
| 4-Phenyl-butyric acid | PhPrCO | 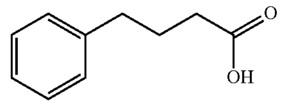 [SMILES: O=C(O)CCCc1ccccc1] |
| Polyethylene glycol | PEG | |
| D-Pipecolic acid | pip | 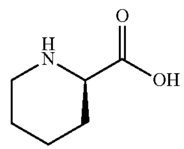 |
| L-Tyrosin(O-Methyl)—OH | Pmy | 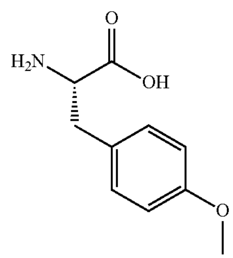 |
| L-Phosphotyrosine | Pty | 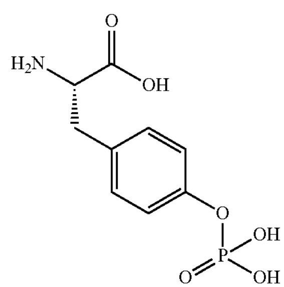 [SMILES: N[C@@H](Cc1ccc(OP(=O)(O)O)cc1)C(=O)O] |
| N-Methylglycine | Sar | 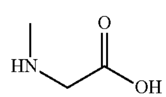 |

TABLE 2-continued

| Name | Abbreviation | Structure |
|---|---|---|
| Selenomethionine | Sem | ![structure] |
| L-2-Thienylalanine | Thi | ![structure] |
| D-thiazolidine-4-carboxylic acid | thz | ![structure] |
| 1,2,3,4-L-tetrahydroisoquinolinecarboxylic acid | Tic | ![structure] |
| L-alpha-t-Butylglycine | Tle | ![structure] |

TABLE 2-continued

| Name | Abbreviation | Structure |
|---|---|---|
| (13-Amino-4,7,10-trioxa-tridecyl)-succinamic acid | Ttds | |
| Ttds-Maleimidopropionyl(EtSH) | Ttds-Maleimidopropionyl(EtSH) | |
| 3-Nitro-L-tyrosine | Tym | 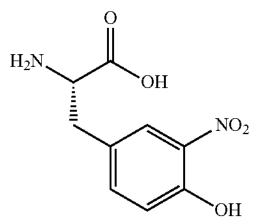 [SMILES: N[C@@H](Cc1ccc(O)c([N+](=O)[O-])c1)C(=O)O] |
| Carboxyfluorescein | FAM | 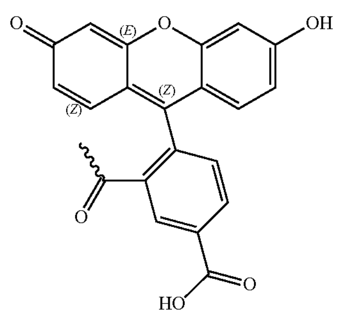 |

TABLE 2-continued

| Name | Abbreviation | Structure |
|---|---|---|
| [2-(2-Amino-ethoxy)-ethoxy]-acetic acid | FA03202 | H₂N~~O~~O~~COOH |
| 3-{2-[2-(2-Amino-ethoxy)-ethoxy]-ethoxy}-propionic acid | FA19203 | H₂N~~O~~O~~O~~COOH |
| 3-(2-{2-[2-(2-Amino-ethoxy)-ethoxy]-ethoxy}-ethoxy)-propionic acid | FA19204 | H₂N~~O~~O~~O~~O~~COOH |
| 3-[2-(2-{2-[2-(2-Amino-ethoxy)-ethoxy]-ethoxy}-ethoxy)-ethoxy]-propionic acid | FA19205 | H₂N~~O~~O~~O~~O~~O~~COOH |

The amino acid sequences of the peptides provided herein are depicted in typical peptide sequence format, as would be understood by the ordinary skilled artisan. For example, the three-letter code or one-letter code of a conventional amino acid, or the three-, four-, or seven-number/letter code additional building blocks, indicates the presence of the amino acid or building block in a specified position within the peptide sequence. The code for each non-conventional amino acid or building block is connected to the code for the next and/or previous amino acid or building block in the sequence by a hyphen. Adjacent amino acids are connected by a chemical bond (typically an amide bond). The formation of the chemical bond removes a hydroxyl group from the 1-carboxyl group of the amino acid when it is located to the left of the adjacent amino acid (e.g., Hle-adjacent amino acid), and removes a hydrogen from the amino group of the amino acid when it is located on the right of the adjacent amino acid (e.g., adjacent amino acid-Hle). It is understood that both modifications can apply to the same amino acid and apply to adjacent conventional amino acids present in amino acid sequences without hyphens explicitly illustrated. Where an amino acid contains more than one amino and/or carboxy group in the amino acid side chain, the 2- or 3-amino group and/or the 1-carboxy group generally are used for the formation of peptide bonds. For non-conventional amino acids, a 3-letter code was used where the first letter indicates the stereochemistry of the C-α-atom. For example, a capital first letter indicates that the L-form of the amino acid is present in the peptide sequence, while a lower case first letter indicating that the D-form of the correspondent amino acid is present in the peptide sequence. When one-letter code is used, a lower case letter represents a D-amino acid, while an upper case letter represents an L-amino acid. Unless indicated to the contrary, the amino acid sequences are presented herein in N- to C-terminus direction.

The C-termini of several TFPI-binding peptide sequences described herein are explicitly illustrated by inclusion of an OH, $NH_2$, or an abbreviation for a specific terminating amine linked to the C-terminal amino acid code via a hyphen. The N-termini of several peptides described herein are explicitly illustrated by inclusion of a hydrogen (for a free N-terminus), or an abbreviation for a specific terminating carboxylic acid or other chemical group linked to the N-terminal amino acid code via a hyphen.

The invention provides a peptide comprising the amino acid sequence $X_7X_8X_9X_{10}X_{11}X_{12}X_{13}X_{14}X_{15}X_{16}X_{17}X_{18}X_{19}X_{20}X_{21}$ (SEQ ID NO: 3109), wherein (using single letter codes for amino acids) $X_7$ is selected from the group consisting of L, P, K, S, W, V, N, and Q; $X_8$ is selected from the group consisting of L, R, N, F, and I; $X_9$ is selected from the group consisting of Y, V, P, and C; $X_{10}$ is selected from the group consisting of F, L, and G; X11 is selected from the group consisting of L, W, V, A, M, T, and S; X12 is selected from the group consisting of T, F, V, R, A, D, L, E, S, and Y; X13 is selected from the group consisting of I, M, G, Q, D, and R; X14 is selected from the group consisting of G, W, Y, L, M, and H; X15 is selected from the group consisting of N, P, F, H, K, and Y; X16 is selected from the group consisting of M, D, E, V, G, and K; X17 is selected from the group consisting of G, I, R, S, T, and L; X18 is selected from the group consisting of M, K, L, and I; X19 is selected from the group consisting of Y, G, R, and S; X20 is selected from the group consisting of A, E, S, C, and Y; and X21 is selected from the group consisting of A, V, K, and E.

In addition to the core structure set forth above, $X_7$-$X_{21}$, other structures that are specifically contemplated are those in which one or more additional amino acids are attached to the core structure (e.g., linked to the N-terminus or the C-terminus of the amino acid sequence $X_7$-$X_{21}$). Thus, the invention includes peptides comprising the core structure and further comprising one or more N-terminal amino acid(s) comprising an amino acid sequence selected from the group consisting of:

$X_6$,
$X_5X_6$,
$X_4X_5X_6$,
$X_3X_4X_5X_6$ (SEQ ID NO: 3110),
$X_2X_3X_4X_5X_6$ (SEQ ID NO: 3111), and
$X_1X_2X_3X_4X_5X_6$ (SEQ ID NO: 3112);

wherein $X_6$ is directly linked to $X_7$ of the core structure amino acid sequence, and $X_1$ is selected from the group consisting of T and G; $X_2$ is selected from the group consisting of F and V; $X_3$ is selected from the group consisting of V, W, Y, and F; $X_4$ is selected from the group consisting of D, Q, and S; $X_5$ is selected from the group consisting of E, T, N, and S; and $X_6$ is selected from the group consisting of R, H, K, and A. The peptide of the invention in one aspect comprises or consists of the amino acid sequence QSKKNVFVFGYFERLRAK (SEQ ID NO: 1).

In another embodiment, the peptide of the invention comprising the core structure comprises one or more C-terminal amino acid(s) comprising an amino acid sequence selected from the group consisting of:

$X_{22}$,
$X_{22}X_{23}$,
$X_{22}X_{23}X_{24}$,
$X_{22}X_{23}X_{24}X_{25}$ (SEQ ID NO: 3113),
$X_{22}X_{23}X_{24}X_{25}X_{26}$ (SEQ ID NO: 3114), and
$X_{22}X_{23}X_{24}X_{25}X_{26}X_{27}$ (SEQ ID NO: 3115), wherein $X_{22}$ is directly linked to $X_{21}$ of the core structure amino acid sequence, and $X_{22}$ is selected from the group consisting of Q, I, E, W, R, L, and N; $X_{23}$ is selected from the group consisting of L, V, M, and R; $X_{24}$ is selected from the group consisting of K, L, A, and Y; $X_{25}$ is F; $X_{26}$ is G; and $X_{27}$ is T.

In one aspect, the peptide of the invention comprises or consists of the amino acid sequence VIVFTFRHNKLIGYERRY (SEQ ID NO: 4). It is also contemplated that the peptide of the invention comprises additional amino acids at both the N-terminus and the C-terminus of the core structure. In this aspect, the peptide comprises or consists of the amino acid sequence TFVDERLLYFLTIGNMGMYAAQLKF (SEQ ID NO: 3), GVWQTHPRYFWTMWPDIKGEVIV-LFGT (SEQ ID NO: 5), KWFCGMRDMKGTMSCVWVKF (SEQ ID NO: 6), or ASFPLAVQLHVSKRSKEMA (SEQ ID NO: 7).

The invention further includes peptides comprising the amino acid sequence $X_3X_4X_5$-F-$X_7$-NVF-$X_{11}X_{12}$-GY-$X_{15}X_{16}$-RLRAK-$X_{22}$ (SEQ ID NO: 2), wherein $X_3$ is Y or F; $X_4$ is Q or S; $X_5$ is N or S; $X_7$ is K, N, or Q; $X_{11}$ is V, A, S, or T; $X_{12}$ is F, A, D, L, Q, S, or Y; $X_{15}$ is F, K, or Y; $X_{16}$ is E or D; and $X_{22}$ is L or N.

In addition, the invention provides a peptide that binds TFPI, wherein the peptide comprises the structure of formula (I): X1001-X1002-X1003-X1004-X1005-X1006-X1007-X1008-X1009-X1010-X1011-X1012-X1013-X1014-X1015-X1016-X1017-X1018-X1019-X1020 (SEQ ID NO: 3116). In formula (I), X1001 is an amino acid selected from the group consisting of Bhf, C, D, F, G, H, I, K, L, M, N, Nmf, Q, R, T, V, W, and Y; X1002 is an amino acid selected from the group consisting of G, K, and Q; X1003 is an amino acid selected from the group consisting of A, Aib, Bhs, C, D, E, F, G, H, I, K, L, M, N, P, Q, R, S, T, V, W, and Y; X1004 is an amino acid selected from the group consisting of, A, Aib, Bhk, C, D, E, F, G, H, I, K, k, L, M, N, Nmk, P, Q, R, S, T, V, W, and Y; X1005 is an amino acid selected from the group consisting of a, A, Aib, Bal, C, D, d, E, F, G, H, K, k, L, M, N, Nmg, p, Q, R, S, T, V, W, and Y; X1006 is an amino acid selected from the group consisting of A, Aib, Btq, C, D, E, F, G, H, I, K, L, M, N, Q, R, S T, V, W, and Y; X1007 is an amino acid selected from the group consisting of A, F, G, I, K, L, Nmv, P, Q, S, V, W, and Y; X1008 is an amino acid selected from the group consisting of F, H, K, W, and Y; X1009 is an amino acid selected from the group consisting of A, Aib, f, I, K, S, T, and V; X1010 is an amino acid selected from the group consisting of A, Aib, C, D, E, F, G, H, I, K, L, M, N, Nmf, P, Q, R, S, T, V, W, and Y; X1011 is an amino acid selected from the group consisting of Aib, C, K, G, and Nmg; X1012 is Y; X1013 is an amino acid selected from the group consisting of A, Aib, C, E, F, G, H, K, L, M, Q, R, W, and Y; X1014 is an amino acid selected from the group consisting of A, Aib, Bhe, C, D, E, F, G, H, I, K, L, M, N, P, Q, R, S, T, V, W, and Y; X1015 is an amino acid selected from the group consisting of (omega-methyl)-R, D, E, K, and R; X1016 is L; X1017 is an amino acid selected from the group consisting of (omega-methyl)-R, A, Aib, Bhr, C, Cha, Cit, D, Dab, Dap, E, Eag, Eew, F, G, H, Har, Hci, Hle, I, K, L, M, N, Nle, Nva, Opa, Orn, Q, R, S, T, V, W, and Y; X1018 is an amino acid selected from the group consisting of A, Bal, C, D, E, F, G, H, I, K, L, M, N, Q, R, S, T, V, W, and Y; and X1019 is an amino acid selected from the group consisting of Bhk, K, R, and V. X1020 is either present or absent in formula (I) (i.e., in some instances, the peptide of the invention comprises the structure X1001-X1002-X1003-X1004-X1005-X1006-X1007-X1008-X1010-X1011-X1012-X1013-X1014-X1015-X1016-X1017-X1018-X1019 (SEQ ID NO: 3116)). When X1020 is present, it is an amino acid selected from the group consisting of Aib, Bhl, C, F, G, H, I, K, L, Nml, Q, R, S, T, V, W, and Y.

For example, the peptide of the invention comprises the structure of formula (I) wherein X1001 is an amino acid selected from the group consisting of C, F, I, K, L, Nmf, V, M, W, and Y; X1002 is Q; X1003 is an amino acid selected from the group consisting of A, C, D, E, H, K, M, I, N, Q, R, S, T, and V; X1004 is an amino acid selected from the group consisting of A, Aib, C, D, E, G, H, F, I, K, k, L, M, N, Nmk, P, Q, R, S, V, W, and Y; X1005 is an amino acid selected from the group consisting of a, A, Aib, Bal, C, d, E, D, F, G, H, K, k, L, M, N, Nmg, p, Q, R, S, T, and Y; X1006 is an amino acid selected from the group consisting of A, Btq, C, D, G, I, K, H, L, M, N, Q, R, S, V, and Y; X1007 is an amino acid selected from the group consisting of I, K, L, Q, V, and Y; X1008 is an amino acid selected from the group consisting of F, H, and Y; X1009 is an amino acid selected from the group consisting of f, I, and V; X1010 is an amino acid selected from the group consisting of A, D, E, F, G, H, K, L, M, N, P, Q, R, S, T, V, W, and Y; X1011 is an amino acid selected from the group consisting of G and Nmg; X1012 is Y; X1013 is an amino acid selected from the group consisting of Aib, C, F, H, L, W, and Y; X1014 is an amino acid selected from the group consisting of A, Aib, Bhe, C, D, E, H, I, K, L, M, N, Q, R, S, T, V, W, and Y; X1015 is an amino acid selected from the group consisting of E and R; X1016 is L; X1017 is an amino acid selected from the group consisting of (omega-methyl)-R, A, Aib, Bhr, C, Cha, Cit, Dab, Dap, Eag, Eew, F, H, Har, Hci, Hle, I, K, L, M, N, Nle, Nva, Opa, Orn, R, S, T, V, and Y; X1018 is an amino acid selected from the group consisting of A, C, D, E, F, I, K, L, M, N, Q, R, V, and W; X1019 is an amino acid selected from the group consisting of K and R; and X1020 is an amino acid selected from the group consisting of Aib, Bhl, F, K, L, R, and W (when X1020 is present in the peptide).

In one aspect, the peptide of the invention comprises the structure of formula (I) wherein X1001 is an amino acid selected from the group consisting of F, L, Y, and M; X1002 is Q; X1003 is an amino acid selected from the group consisting of M, Q, R, S, T, and C; X1004 is an amino acid selected from the group consisting of Aib, K, L, P, R, E, G, I, Y, M, and W; X1005 is an amino acid selected from the group consisting of a, Aib, D, d, G, H, K, k, N, Nmg, p, Q, R, A, E, C, and M; X1006 is an amino acid selected from the group consisting of A, C, D, G, H, K, N, Q, R, S, and M; X1007 is an amino acid selected from the group consisting of I and V; X1008 is an amino acid selected from the group consisting of F, H, and Y; X1009 is V; X1010 is an amino acid selected from the group consisting of A, D, E, K, M, N, Q, R, F, H, P, S, V, W, and Y; X1011 is G; X1012 is Y; X1013 is C or F; X1014 is an amino acid selected from the group consisting of A, C, D, E, K, L, M, N, Q, R, T, V, and Aib; X1015 is R; X1016 is L; X1017 is an amino acid selected from the group consisting of A, Aib, C, Cha, Dab, Dap, Eag, Eew, H, Har, Hci, Hle, K, Nle, Nva, Opa, Orn, R, I, L, S, and M; X1018 is an amino acid selected from the group consisting of A, L, N, M, and R; X1019 is K; and X1020 is K or L.

When amino acid X1020 is absent from formula (I), the peptide of the invention in one aspect further comprises amino acid X1000 at the N-terminus of formula (I), such that the peptide comprises or consists of the structure of formula (II): X1000-X1001-X1002-X1003-X1004-X1005-X1006-X1007-X1008-X1009-X1010-X1011-X1012-X1013-X1014-X1015-X1016-X1017-X1018-X1019 (II) (SEQ ID NO: 3122). When X1000 is present in the peptide, X1000 is an amino acid selected from the group consisting of A, E, and P, while the amino acids of X1001-X1019 are as defined above.

In an additional aspect, the TFPI-binding peptide of the invention comprises the structure of formula (III): X1001-Q-X1003-X1004-X1005-X1006-I/V-X1008-V-X1010-G-Y-C/F-X1014-R-L-X1017-X1018-K-K/L (III) (SEQ ID NO: 3117). As used herein, amino acid designations separated by "/" refer to alternative amino acid residues at the indicated position. For example, with respect to formula (III), the amino acid residue at position 7 is isoleucine or valine. X1001, X1003, X1004, X1005, X1006, X1008, X1010, X1014, X1017 and X1018 in formula (III) are each independently selected from any amino acid. For example, in formula (III), X1001 is optionally an amino acid selected from the group consisting of Bhf, C, D, F, G, H, I, K, L, M, N, Nmf, Q, R, T, V, W, and Y, such as an amino acid selected from the group consisting of C, F, I, K, L, Nmf, V, M, W, and Y (e.g., an amino acid selected from the group consisting of F, L, Y and M); X1003 is optionally an amino acid selected from the group consisting of A, Aib, Bhs, C, D, E, F, G, H, I, K, L, M, N, P, Q, R, S, T, V, W, and Y, such as an amino acid selected from the group consisting of A, C, D, E, H, K, M, I, N, Q, R, S, T, and V (e.g., the amino acid is M, Q, R, S, T or C); X1004 is optionally an amino acid selected from the group consisting of, A, Aib, Bhk, C, D, E, F, G, H, I, K, k, L, M, N, Nmk, P, Q, R, S, T, V, W, and Y, such as an amino acid selected from the group consisting of A, Aib, C, D, E, G, H, F, I, K, k, L, M, N, Nmk, P, Q, R, S, V, W, and Y (e.g., an amino acid selected from the group consisting of Aib, K, L, P, R, E, G, I, Y, M, and W); X1005 is optionally an amino acid selected from the group consisting of a, A, Aib, Bal, C, D, d, E, F, G, H, K, k, L, M, N, Nmg, p, Q, R, S, T, V, W, and Y, such as an amino acid selected from the group consisting of a, A, Aib, Bal, C, d, E, D, F, G, H, K, k, L, M, N, Nmg, p, Q, R, S, T, and Y (e.g., the amino acid is a, Aib, D, d, G, H, K, k, N, Nmg, p, Q, R, A, E, C, or M); X1006 is optionally an amino acid selected from the group consisting of A, Aib, Btq, C, D, E, F, G, H, I, K, L, M, N, Q, R, S, T, V, W, and Y, such as an amino acid selected from the group consisting of A, Btq, C, D, G, I, K, H, L, M, N, Q, R, S, V, and Y (e.g., an amino acid selected from the group consisting of A, C, D, G, H, K, N, Q, R, S, and M); X1008 is optionally an amino acid selected from the group consisting of F, H, K, W, and Y, such as an amino acid selected from the group consisting of F, H, and Y; X1010 is optionally an amino acid selected from the group consisting of A, Aib, C, D, E, F, G, H, I, K, L, M, N, Nmf, P, Q, R, S, T, V, W, and Y, such as an amino acid selected from the group consisting of A, D, E, F, G, H, K, L, M, N, P, Q, R, S, T, V, W, and Y (e.g., an amino acid selected from the group consisting of A, D, E, K, M, N, Q, R, F, H, P, S, V, W, and Y); X1014 is optionally an amino acid selected from the group consisting of A, Aib, Bhe, C, D, E, F, G, H, I, K, L, M, N, P, Q, R, S, T, V, W, and Y, such as an amino acid selected from the group consisting of A, Aib, Bhe, C, D, E, H, I, K, L, M, N, Q, R, S, T, V, W, and Y (e.g., A, C, D, E, K, L, M, N, Q, R, T, V, or Aib); X1017 is optionally an amino acid selected from the group consisting of (omega-methyl)-R, A, Aib, Bhr, C, Cha, Cit, D, Dab, Dap, E, Eag, Eew, F, G, H, Har, Hci, Hle, I, K, L, M, N, Nle, Nva, Opa, Orn, Q, R, S, T, V, W, and Y, such as an amino acid selected from the group consisting of (omega-methyl)-R, A, Aib, Bhr, C, Cha, Cit, Dab, Dap, Eag, Eew, F, H, Har, Hci, Hle, I, K, L, M, N, Nle, Nva, Opa, Orn, R, S, T, V, and Y (e.g., an amino acid selected from the group consisting of A, Aib, C, Cha, Dab, Dap, Eag, Eew, H, Har, Hci, Hle, K, Nle, Nva, Opa, Orn, R, I, L, S, and M); and/or X1018 is optionally an amino acid selected from the group consisting of A, Bal, C, D, E, F, G, H, I, K, L, M, N, Q, R, S, T, V, W, and Y, such as an amino acid selected from the group consisting of A, C, D, E, F, I, K, L, M, N, Q, R, V, and W (e.g., an amino acid selected from the group consisting of A, L, N, M, and R).

In some embodiments, the peptide of the invention comprises one or more additional amino acid residues attached to the N- or C-terminus of the amino acid sequence. For example, the peptide comprising the structure of any one of formulas (I)-(III), in some embodiments, further comprises one or more N-terminal amino acid(s) directly linked to X1001, wherein the N-terminal amino acid(s) comprise the amino acid sequence selected from the group consisting of X1000, X999-X1000, X998-X999-X1000, X997-X998-X999-X1000 (SEQ ID NO: 3123), X996-X997-X998-X999-X1000 (SEQ ID NO: 3124), X995-X996-X997-X998-X999-X1000 (SEQ ID NO: 3125), X994-X995-X996-X997-X998-X999-X1000 (SEQ ID NO: 3126), X993-X994-X995-X996-X997-X998-X999-X1000 (SEQ ID NO: 3127), X992-X993-X994-X995-X996-X997-X998-X999-X1000 (SEQ ID NO: 3128), X991-X992-X993-X994-X995-X996-X997-X998-X999-X1000 (SEQ ID NO: 3129), and X990-X991-X992-X993-X994-X995-X996-X997-X998-X999-X1000 (SEQ ID NO: 3130). When the peptide comprises one or more N-terminal amino acids, X1000 is A or K; X999 is V or K; X998 is Q or K; X997 is L or K; X996 is R or K; X995 is G or K; X994 is V or K; X993 is G or K; X992 is S or K; X991 is K; and X990 is K.

In addition to the core structures set forth in formulas (I)-(III), other structures that are specifically contemplated are those in which one or more additional amino acids are attached to the C-terminus of the core structure directly linked to X1020. For example, the C-terminal addition optionally comprises an amino acid sequence selected from the group consisting of X1021, X1021-X1022, X1021-X1022-X1023, and X1021-X1022-X1023-X1024 (SEQ ID NO: 3131), wherein X1021 is T or K; X1022 is S or K; and X1023 and X1024 are K.

The invention further includes a TFPI-binding peptide comprising or consisting of an amino acid sequence having at least 60% identity (e.g., at least 65%, at least 70%, at least 75%, at least 80%, at least 85%, at least 90%, at least 95% or 100% identity) to the amino acid sequence Ac-FQSK-Nmg-NVFVDGYFERL-Aib-AKL-NH2 (formula IV) (SEQ ID NO: 164). In some instances, the peptide comprises or consists of the amino acid sequence of any one of formulas (I)-(III), as described herein. The invention also includes a peptide comprising or consisting of an amino acid sequence selected from the group consisting of SEQ ID NOs: 8-978 (e.g., a peptide comprising or consisting of the amino acid sequence selected from the group consisting of SEQ ID NOs: 8-741 and 962-972 (such as SEQ ID NOs: 8-741, 962-968, 971, or 972) and/or selected from the group consisting of 742-961 (such as SEQ ID NOs: 744-961) and/or selected from the group consisting of SEQ ID NOs: 973-978).

The invention includes peptides that comprise a cyclic structure. In this regard, the invention includes peptides comprising cyclic structures within the peptide (e.g., one or more loops formed by linkage between amino acids other than the N- and C-terminal amino acids), peptides comprising a cyclic structure formed by the interaction of a terminal amino acid with an amino acid within the peptide sequence, and peptides cyclized head to tail. The peptide may also be part of a larger cyclic structure formed by surrounding additional amino acids or chemical substituents. The peptides of the invention, in some instances, comprise intramolecular disulfide bonds. In some embodiments, the intramolecular disulfide bonds are formed by cysteine residues. Peptides comprising cyclic structures formed by non-cysteine residues, or a non-cysteine residue and a cysteine residue, also are provided. For example, in one embodiment, the inventive peptide comprises at least one non-conventional amino acid or chemical moiety that mediates cyclization. Suitable non-conventional amino acids or chemical moieties include, but are not limited to, FA19205, FA19204, FA19203, FA03202, Hcy, hcy, Cea, and c. The amino acids or moieties responsible for cyclization are sufficiently spaced apart to allow formation of a loop structure, e.g., the amino acids or moieties are separated by two, three, four, five, six, seven, eight, or more residues.

In one aspect, the peptide comprising the structure of formulas (I)-(III) contains at least two cysteine residues (e.g., the peptide contains two cysteine residues) that are spaced apart by at least three amino acid residues such that the cysteines form an intramolecular disulfide bond. In some instances, the cysteines are spaced apart by more than three amino acid residues. For example, in the peptide comprising the structure of formulas (I), (II), or (III), any two of X1000, X1001, X1003, X1004, X1005, X1006, X1010, X1011, X1013, X1014, X1017, X1018, X1020 and X1021 are optionally cysteines capable of forming a disulfide bridge. Accordingly, in some aspects, the peptide contains two cysteine residues: one of X1000, X1005, X1010 and X1014 is cysteine, and one of X1006, X1010, X1017 and X1021 is a cysteine. The invention contemplates all of the possible combinations of cysteine pairs, e.g., X1000 and X1006 are C; X1000 and X1010 are C; X1000 and X1017 are C; X1005 and X1017 are C; X1010 and X1017 are C; X1010 and X1021 are C; or X1014 and X1021 are C. Other exemplary cyclic peptides of the invention include, e.g., JBT2441, JBT2450, JBT2466-JBT2469, JBT2489-JBT2495, JBT2497-JBT2499, and JBT2513-JBT2518 (SEQ ID NOs: 4159, 4167, 4181-4184, 4204-4210, 4212-4214, and 4228-4233, respectively.).

The invention further provides a peptide that binds TFPI, the peptide comprising the structure of formula (V): X2001-X2002-X2003-X2004-X2005-X20064-[X2007-X2008-

X2009-X2010-X2011-X2012-X2013-X2014-X2015-X2016-X2017-X2018]-X2019-X2020-X2021-X2022-X2023 (V) (SEQ ID NO: 3118), wherein the peptide forms a cyclic structure generated by a linkage, e.g., a disulfide bond, between X2007 and X2018 (denoted as brackets within formula (V)). In formula (V), X2001, X2002, and X2023 are independently either present or absent. When present, X2001 is an amino acid selected from the group consisting of A, D, E, F, G, H, I, K, L, P, R, S, T, V, and W; X2002 an amino acid selected from the group consisting of A, D, E, F, G, H, I, K, L, M, P, R, S, T, V, and W; and X2023 is an amino acid selected from the group consisting of A, D, E, F, G, I, K, L, R, S, T, V, W, and Y. In addition, X2003 is an amino acid selected from the group consisting of A, F, I, K, L, R, S, T, V, W, and Y; X2004 is an amino acid selected from the group consisting of A, D, E, F, G, I, K, L, R, S, T, V, and W; X2005 is W; X2006 is an amino acid selected from the group consisting of F, H, I, K, L, R, V, and W; X2007 is an amino acid selected from the group consisting of C, Hcy, Dap, and K (e.g., C or Hcy); X2008 is an amino acid selected from the group consisting of A, G, R, S, and T; X2009 is an amino acid selected from the group consisting of a, A, I, K, L, M, m, Nle, p, R, Sem, and V; X2010 is an amino acid selected from the group consisting of A, G, I, K, L, P, R, S, T, and V; X2011 is an amino acid selected from the group consisting of D, E, G, S, and T; X2012 is an amino acid selected from the group consisting of A, a, D, d, E, e, F, f, G, I, K, k, L, l, M, m, Nle, nle, P, p, R, r, S, s, Sem, T, t, V, v, W, and w; X2013 is an amino acid selected from the group consisting of A, D, d, E, e, F, G, I, K, L, R, S, s, T, V, and W; X2014 is an amino acid selected from the group consisting of A, D, E, F, G, I, K, L, M, R, S, T, V, and W; X2015 is an amino acid selected from the group consisting of A, D, E, F, G, I, K, L, M, Nle, R, S, T, V, and W; X2016 is an amino acid selected from the group consisting of A, D, E, F, I, K, L, M, Nle, R, S, Sem, T, V, W, and Y; X2017 is an amino acid selected from the group consisting of A, D, E, F, G, I, K, L, R, S, T, V, W, and Y; X2018 is an amino acid selected from the group consisting of C and D (e.g., X2018 is C); X2019 is an amino acid selected from the group consisting of A, F, I, L, S, T, V, and W; X2020 is an amino acid selected from the group consisting of F and W; X2021 is an amino acid selected from the group consisting of I, L, and V; and X2022 is an amino acid selected from the group consisting of A, D, E, F, G, I, K, L, P, R, S, T, V, and W.

In some instances, in the peptide of the invention comprising the structure of formula (V), X2001 is optionally an amino acid selected from the group consisting of A, D, F, G, H, K, L, P, and S, such as an amino acid selected from the group consisting of A, D, F, G, H, K, L, and S (when X2001 is present); X2002 is optionally an amino acid selected from the group consisting of A, D, F, G, H, K, L, P, R, and S, such as an amino acid selected from the group consisting of A, F, H, K, L, M, R, and S (e.g., H, F, M or R) (when X2002 is present); X2003 is optionally an amino acid selected from the group consisting of A, F, K, L, S, and Y, such as an amino acid selected from the group consisting of F, S, and Y (e.g., F or Y); X2004 is optionally an amino acid selected from the group consisting of A, D, F, G, K, L, and S (e.g., K); X2005 is optionally W; X2006 is optionally an amino acid selected from the group consisting of F, H, K, and L (e.g., F or H); X2007 is optionally an amino acid selected from the group consisting of C and HcY (e.g., X2007 is C); X2008 is optionally an amino acid selected from the group consisting of A, G, and S; X2009 is optionally an amino acid selected from the group consisting of a, A, K, L, V, M, m, Nle, Sem, and p, such as an amino acid selected from the group consisting of M, Nle, p, and V (e.g., M, Sem, or V); X2010 is optionally an amino acid selected from the group consisting of A, G, K, L, P, R, and S, such as an amino acid selected from the group consisting of A, K, L, P, R and S (e.g., K, P, or R); X2011 is optionally an amino acid selected from the group consisting of D, G, and S (e.g., D or S); X2012 is optionally an amino acid selected from the group consisting of A, a, D, d, F, f, G, K, k, L, l, M, m, Nle, P, S, and s, such as an amino acid selected from the group consisting of D, d, F, f, G, K, k, L, l, M, Nle, P, S, and Sem (e.g., an amino acid selected from the group consisting of F, L, l, Sem, and M); X2013 is optionally an amino acid selected from the group consisting of A, D, d, F, G, K, L, S, and s, such as an amino acid selected from the group consisting of A, D, F, G, K, L and S (e.g., D, G, K, or S); X2014 is optionally an amino acid selected from the group consisting of D, F, G, K, L, and S (e.g., D or G); X2015 is optionally an amino acid selected from the group consisting of A, D, F, G, I, K, L, M, Nle, S, and T (e.g., I or T); X2016 is optionally an amino acid selected from the group consisting of D, F, K, L, M, Nle, S, and Y, such as an amino acid selected from the group consisting of D, F, K, L, M, Nle, S, Sem, and Y (e.g., D, F, M, Sem, or Y); X2017 is optionally an amino acid selected from the group consisting of A, D, F, G, K, L, S, T, and Y (e.g., S or T); X2018 is optionally C; X2019 is optionally an amino acid selected from the group consisting of A, F, L, S, and V (e.g., A or V); X2020 is optionally an amino acid selected from the group consisting of F and W (e.g., W); X2021 is optionally an amino acid selected from the group consisting of L and V (e.g., V); X2022 is optionally an amino acid selected from the group consisting of A, D, F, G, K, L, P, R, S, and W, such as an amino acid selected from the group consisting of A, F, G, K, L, P, R, S, and W (e.g., an amino acid selected from the group consisting of F, L, K, R, P, and W); and X2023 is optionally an amino acid selected from the group consisting of A, D, F, G, K, L, M, S, and Y, such as an amino acid selected from the group consisting of A, D, F, G, L M, S, and Y (e.g., an amino acid sequence selected from the group consisting of A, D, F, M, S and Y) (when X2023 is present).

The invention further includes a peptide that binds TFPI, wherein the peptide comprises the structure of formula (VI): X2001-X2002-F/Y-K-W-F/H-[C-X2008-M/V-X2010-D-X2012-X2013-G-I/T-X2016-SIT-C]-A/V-W-V-X2022-X2023 (VI) (SEQ ID NO: 3119). In the peptide comprising the structure of formula (VI), X2001, X2002 and X2023 are each independently present or absent. If X2001, X2002, and/or X2023 are present, any of X2001, X2002 and X2023 is independently selected from any amino acid. In addition, X2008, X2010, X2012, X2013, X2016, and X2022 are each independently selected from any amino acid.

In some aspects, in the peptide of formula (VI), X2001 is optionally an amino acid selected from the group consisting of A, D, E, F, G, H, I, K, L, P, R, S, T, V, and W, such as an amino acid selected from the group consisting of A, D, F, G, H, K, L, P, and S (e.g., an amino acid selected from the group consisting of A, D, F, G, H, K, L, and S) (when X2001 is present); X2002 is optionally an amino acid selected from the group consisting of A, D, E, F, G, H, I, K, L, M, P, R, S, T, V, and W, such as an amino acid selected from the group consisting of A, D, F, G, H, K, L, M, P, R, and S (e.g., an amino acid selected from the group consisting of A, F, H, K, L, M, R, and S, such as H, F, M, or R) (when X2002 is present); X2008 is optionally an amino acid selected from the group consisting of A, G, R, S, and T, such as an amino acid selected from the group consisting of A, G, and S; X2010 is optionally an amino acid selected from the group consisting of A, G, I, K, L, P, R, S, T, and V, such as an amino acid selected from the group consisting of A, G, K, L, P, R, and S (e.g., an amino acid selected from the group consisting of A, K, L, P, R, and S, such as K, P or R); X2012 is optionally an amino acid selected from the group consisting of A, a, D, d, E, e, F, f, G, I, I, K, k, L, l, M, m, Nle, nle, P, p, R, r, S, s, Sem, T, t, V, v, W, and w, such as an amino acid selected from the group consisting of A, a, D, d, F, f, G, K, k, L, l, M, m, Nle, P, S, s, and Sem (e.g., an amino acid selected from the group consisting of D, d, F, f, G, K, k, L, l, M, Nle, P, S, and Sem, such as F, L, l, Sem, or M); X2013 is optionally an amino acid selected from the group consisting of A, D, d, E, e, F, G, I, K, L, R, S, s, T, V, and W, such as an amino acid selected from the group consisting of A, D, d, F, G, K, L, S, and s (e.g., an amino acid selected from the group consisting of A, D, F, G, K, L, and S, such as D, G, K, or S); X2016 is optionally an amino acid selected from the group consisting of A, D, E, F, I, K, L, M, Nle, R, S, Sem, T, V, W, and Y, such as an amino acid selected from the group consisting of D, F, K, L, M, Nle, S, Sem, and Y (e.g., an amino acid selected from the group consisting of D, F, K, L, M, Nle, S, and Sem, such as F, Sem, or M); X2022 is optionally an amino acid selected from the group consisting of A, D, E, F, G, I, K, L, P, R, S, T, V, and W, such as an amino acid selected from the group consisting of A, D, F, G, K, L, P, R, S, and W (e.g., an amino acid selected from the group consisting of A, F, G, K, L, P, R, S, and W, such as F, L, K, R, P, or W); and/or X2023 is optionally an amino acid selected from the group consisting of A, D, E, F, G, I, K, L, R, M, S, T, V, W, and Y, such as an amino acid selected from the group consisting of A, D, F, G, K, L, M, S, and Y (e.g., an amino acid selected from the group consisting of A, D, F, G, L M, S, and Y, such as A, D, F, M, S, or Y) (when X2023 is present).

The TFPI-binding peptide of the invention, in one aspect, comprises an amino acid sequence having at least 60% identity (e.g., at least 60%, at least 65%, at least 70%, at least 75%, at least 80%, at least 85%, at least 90%, at least 95% or 100% identity) to the sequence of formula VII: Ac-FYYKWH[CG-MRDMKGTMSC]AWVKF-NH2 (VII) (SEQ ID NO: 1040). Optionally, the peptide comprises or consists of the amino acid sequence of formula (V)-(VII) as defined herein. The invention also includes a peptide comprising or consisting of the amino acid sequence selected from the group consisting of SEQ ID NOs: 1001-1293 (e.g., a peptide comprising or consisting of the amino acid sequence selected from the group consisting of SEQ ID NOs: 1001-1212 and 1290-1291 (such as SEQ ID NOs: 1001-120, 1290, or 1291) and/or selected from the group consisting of SEQ ID NOs: 1213-1289 and/or selected from the group consisting of 1292 and 1293). The invention also includes a peptide comprising (or consisting of) the amino acid sequence selected from the group consisting of SEQ ID NOs: 1337-1355 and 4240-4268 (JBT0496, JBT1165, JBT2330-JBT2338, JBT2341, JBT2342, JBT2346-2348, JBT2356, JBT2457, JBT2538, JBT2519-JBT2523, JBT2527-JBT2529, JBT2531-JBT2534, JBT2537, JBT2539-JBT2541, JBT2543-JBT2555).

The invention further provides a TFPI-binding peptide comprising at least amino acids 3-21 (X3003-X3021) of the structure of formula (VIII): X3001-X3002-X3003-X3004-X3005-X3006-X3007-X3008-X3009-X3010-X3011-X3012-X3013-X3014-X3015-X3016-X3017-X3018-X3019-X3020-X3021 (VIII) (SEQ ID NO: 3120). In formula (VIII), X3001 and X3002 are independently either present or absent in the peptide. If present, X3001 is an amino acid selected from the group consisting of A, C, D, F, G, I, K, L, M, N, P, Q, R, S, T, W, E, H, and Y; and X3002 is an amino acid selected from the group consisting of A, C, D, F, H, K, M, N, P, R, S, T, W, Y, G, I, and L. In addition, X3003 is an amino acid selected from the group consisting of A, C, D, E, F, G, H, I, K, L, M, N, P, Q, R, S, T, W, and Y; X3004 is an amino acid selected from the group consisting of A, C, D, E, F, G, H, I, K, L, M, N, Q, R, S, T, V, W, Y, and P; X3005 is an amino acid selected from the group consisting of C, D, F, G, H, I, K, L, M, N, P, R, S, T, V, W, and Y; X3006 is an amino acid selected from the group consisting of A, W, C, K, P, R, and H; X3007 is an amino acid selected from the group consisting of Q, A, C, F, G, H, I, K, L, N, R, S, T, W, and Y; X3008 is an amino acid selected from the group consisting of A, C, F, G, H, K, L, M, N, P, Q, R, S, T, V, W, Y, and I; X3009 is an amino acid selected from the group consisting of A, C, F, G, H, I, L, M, R, S, T, V, W, Y, and K; X3010 is an amino acid selected from the group consisting of A, C, F, G, H, I, K, L, M, N, P, Q, R, S, T, V, W, and Y; X3011 is an amino acid selected from the group consisting of A, G, I, K, L, M, N, Q, R, S, T, V, W, Y, C, F, and H; X3012 is an amino acid selected from the group consisting of A, C, H, I, K, L, and R; X3013 is an amino acid selected from the group consisting of A, C, F, G, H, K, L, M, R, S, V, W, Y, and I; X3014 is an amino acid selected from the group consisting of A, C, F, G, H, I, L, M, N, Q, R, S, T, V, W, Y, and K; X3015 is an amino acid selected from the group consisting of A, K, and R; 3016 is an amino acid selected from the group consisting of A, F, K, and R; X3017 is an amino acid selected from the group consisting of A, C, F, G, I, K, L, N, Q, R, S, T, V, W, Y, H, A, and M; X3018 is an amino acid selected from the group consisting of A, C, F, I, K, L, M, Q, R, V, W, and Y; X3019 is an amino acid selected from the group consisting of A, C, D, E, F, G, H, K, L, N, P, Q, R, V, W, Y, and I; X3020 is an amino acid selected from the group consisting of A, C, F, G, H, K, L, M, N, Q, R, V, W, Y, I, and P; and X3021 is an amino acid selected from the group consisting of A, C, H, I, K, L, M, N, P, Q, R, T, V, W, Y, F, and G.

In some aspects of the invention, the peptide comprises the sequence of formula (VIII), wherein X3001 is optionally an amino acid selected from the group consisting of A, C, D, G, I, K, L, M, N, P, Q, R, S, T, W, E, H, and Y, such as an amino acid selected from the group consisting of A, C, D, G, K, L, M, N, P, R, S, T, E, H, and Y (when X3001 is present); X3002 is optionally an amino selected from the group consisting of C, F, H, K, R, S, W, Y, G, I, and L, such as an amino acid selected from the group consisting of C, K, R, W, Y, G, I, and L (when X3002 is present); X3003 is optionally an amino acid selected from the group consisting of A, C, D, F, G, H, I, K, L, M, N, P, Q, R, S, T, and W, such as an amino acid selected from the group consisting of A, C, G, H, I, K, L, M, R, S, T, and W; X3004 is optionally an amino acid selected from the group consisting of A, C, D, G, H, I, K, L, M, N, R, S, T, V, and P, such as an amino acid selected from the group consisting of A, C, G, H, I, K, L, M, N, R, S, T, and P; X3005 is optionally an amino acid selected from the group consisting of C, F, H, I, K, M, R, T, W, and Y, such as an amino acid selected from the group consisting of C, F, H, K, R, and W; X3006 is optionally an amino acid selected from the group consisting of P, H, and A; X3007 is optionally an amino acid selected from the group consisting of C, G, R, W, A, and L, such as an amino acid selected from the group consisting of L, C, R, and W; X3008 is optionally an amino acid selected from the group consisting of A, C, F, G, H, K, L, M, N, Q, R, T, V, W, Y, and I, such as an amino acid selected from the group consisting of A, C, F, H, K, R, V, W, Y, and I; X3009 is optionally an amino acid selected from the group consisting of C, I, R, V, and K, such as an amino acid selected from the group consisting of C, R, V, and K; X3010 is optionally an amino acid selected from the group consisting of A, C, G, H, I, K, L, M, Q, R, S, and T, such as an amino acid selected from the group consisting of A, C, K, L, Q, R, and S; X3011 is optionally an amino acid selected from the group consisting of A, I, K, L, M, R, S, V, W, C, F, and H, such as an amino acid selected from the group consisting of I, K, L, M, R, V, W, C, F, and H; X3012 is optionally an amino acid selected from the group consisting of H and R (e.g., H); X3013 is optionally an amino acid selected from the group consisting of C, F, K, L, M, R, V, and I, such as an amino acid selected from the group consisting of C, K, R, V, and I; X3014 is optionally an amino acid selected from the group consisting of A, M, C, F, H, I, L, N, R, S, V, W, and K, such as an amino acid selected from the group consisting of A, S, C, F, H, I, R, and K; X3015 is optionally K or R; X3016 is optionally K or R; X3017 is optionally an amino acid selected from the group consisting of A, C, F, G, I, K, L, N, Q, R, S, T, V, W, H, A, and M, such as an amino acid selected from the group consisting of C, G, I, K, L, N, Q, R, S, T, V, H, A, and M; X3018 is optionally an amino acid selected from the group consisting of A, K, C, I, L, R, and W (e.g., K, C, I, R, or W); X3019 is optionally an amino acid selected from the group consisting of A, C, E, H, K, N, Q, R, and I, such as an amino acid selected from the group consisting of C, E, H, K, R, and I; X3020 is optionally an amino acid selected from the group consisting of C, H, L, M, R, V, I, and P (e.g., C, M, I, or P); and X3021 is optionally an amino acid selected from the group consisting of A, C, H, I, K, L, M, N, Q, R, V, W, Y, F, and G, such as an amino acid selected from the group consisting of A, C, H, I, K, L, M, N, Q, R, V, W, F, and G.

The invention further provides a peptide that binds TFPI and comprises at least amino acids 3-21 (X3003-X3021) of the structure of formula (IX): X3001-X3002-X3003-X3004-X3005-X3006-X3007-X3008-X3009-X3010-X3011-H-X3013-X3014-K/R-R-X3017-X3018-X3019-X3020-X3021 (IX) (SEQ ID NO: 3121). In formula (IX), X3001 and X3002 are independently either present or absent in the peptide. If present, X3001 and/or X3002 are independently selected from any amino acid. Likewise, X3003, X3004, X3005, X3006, X3007, X3008, X3009, X3010, X3011, X3013, X3014, X3017, X3018, X3019, X3020 and X3021 are each independently selected from any amino acid. When present, X3001 is optionally an amino acid selected from the group consisting of A, C, D, F, G, I, K, L, M, N, P, Q, R, S, T, W, E, H, and Y, such as an amino acid selected from the group consisting of A, C, D, G, I, K, L, M, N, P, Q, R, S, T, W, E, H, and Y (e.g., an amino acid selected from the group consisting of A, C, D, G, K, L, M, N, P, R, S, T, E, H, and Y). Likewise, when present, X3002 is optionally an amino acid selected from the group consisting of A, C, D, F, H, K, M, N, P, R, S, T, W, Y, G, I, and L, such as an amino acid selected from the group consisting of C, F, H, K, R, S, W, Y, G, I, and L (e.g., an amino acid selected from the group consisting of C, K, R, W, Y, G, I, and L). Also with respect to formula (IX), X3003 is optionally an amino acid selected from the group consisting of A, C, D, E, F, G, H, I, K, L, M, N, P, Q, R, S, T, W, and Y, such as an amino acid selected from the group consisting of A, C, D, F, G, H, I, K, L, M, N, P, Q, R, S, T, and W (e.g., an amino acid selected from the group consisting of A, C, G, H, I, K, L, M, R, S, T, and W); X3004 is optionally an amino acid selected from the group consisting of A, C, D, E, F, G, H, I, K, L, M, N, Q, R, S, T, V, W, Y, and P, such as an amino acid selected from the group consisting of A, C, D, G, H, I, K, L, M, N, R, S, T, V, and P (e.g., an amino acid selected from the group consisting of A, C, G, H, I, K, L, M, N, R, S, T, and P); X3005 is optionally an amino acid selected from the group consisting of C, D, F, G, H, I, K, L, M, N, P, R, S, T, V, W, and Y, such as an amino acid selected from the group consisting of C, F, H, I, K, M, R, T, W, and Y (e.g., an amino acid selected from the group consisting of C, F, H, K, R, and W); X3006 is optionally an amino acid selected from the group consisting of A, W, C, K, P, R and H, such as an amino acid selected from the group consisting of P, H, and A; X3007 is optionally an amino acid selected from the group consisting of Q, A, C, F, G, H, I, K, L, N, R, S, T, W, and Y, such as an amino acid selected from the group consisting of C, G, R, W, A, and L (e.g., L, C, R, or W); X3008 is optionally an amino acid selected from the group consisting of A, C, F, G, H, K, L, M, N, P, Q, R, S, T, V, W, Y, and I, such as an amino acid selected from the group consisting of A, C, F, G, H, K, L, M, N, Q, R, T, V, W, Y, and I (e.g., an amino acid selected from the group consisting of A, C, F, H, K, R, V, W, Y, and I); X3009 is optionally an amino acid selected from the group consisting of A, C, F, G, H, I, L, M, R, S, T, V, W, Y, and K, such as an amino acid selected from the group consisting of C, I, R, V, and K (e.g., C, R, V, or K); X3010 is optionally an amino acid selected from the group consisting of A, C, F, G, H, I, K, L, M, N, P, Q, R, S, T, V, W, and Y, such as an amino acid selected from the group consisting of A, C, G, H, I, K, L, M, Q, R, S, and T (e.g., an amino acid selected from the group consisting of A, C, K, L, Q, R, and S); X3011 is optionally an amino acid selected from the group consisting of A, G, I, K, L, M, N, Q, R, S, T, V, W, Y, C, F, and H, such as an amino acid selected from the group consisting of A, I, K, L, M, R, S, V, W, C, F, and H (e.g., an amino acid selected from the group consisting of I, K, L, M, R, V, W, C, F, and H); X3013 is optionally an amino acid selected from the group consisting of A, C, F, G, H, K, L, M, R, S, V, W, Y, and I, such as an amino acid selected from the group consisting of C, F, K, L, M, R, V, and I (e.g., C, K, R, V, or I); X3014 is optionally an amino acid selected from the group consisting of A, C, F, G, H, I, L, M, N, Q, R, S, T, V, W, Y, and K, such as an amino acid selected from the group consisting of A, M, C, F, H, I, L, N, R, S, V, W, and K (e.g., an amino acid selected from the group consisting of A, S, C, F, H, I, R, and K); X3017 is optionally an amino acid selected from the group consisting of A, C, F, G, I, K, L, N, Q, R, S, T, V, W, Y, H, A, and M, such as an amino acid selected from the group consisting of A, C, F, G, I, K, L, N, Q, R, S, T, V, W, H, A, and M (e.g., an amino acid selected from the group consisting of C, G, I, K, L, N, Q, R, S, T, V, H, A, and M); X3018 is optionally an amino acid selected from the group consisting of A, C, F, I, K, L, M, Q, R, V, W, and Y, such as an amino acid selected from the group consisting of A, K, C, I, L, R, and W (e.g., K, C, I, R, or W); X3019 is optionally an amino acid selected from the group consisting of A, C, D, E, F, G, H, K, L, N, P, Q, R, V, W, Y, and I, such as an amino acid selected from the group consisting of A, C, E, H, K, N, Q, R, and I (e.g., C, E, H, K, R, or I); X3020 is optionally an amino acid selected from the group consisting of A, C, F, G, H, K, L, M, N, Q, R, V, W, Y, I, and P, such as an amino acid selected from the group consisting of C, H, L, M, R, V, I, and P (e.g., C, M, I, or P); and/or X3021 is optionally an amino acid selected from the group consisting of A, C, H, I, K, L, M, N, P, Q, R, T, V, W, Y, F, and G, such as an amino acid selected from the group consisting of A, C, H, I, K, L, M, N, Q, R, V, W, Y, F, and G (e.g., an amino acid selected from the group consisting of A, C, H, I, K, L, M, N, Q, R, V, W, F, and G).

The TFPI-binding peptide of the invention comprises, in some aspects, an amino acid sequence having at least 60% identity (e.g., at least 65%, at least 70%, at least 75%, at least 80%, at least 85%, at least 90%, at least 95% or 100% identity) to the sequence of formula (X): Ac-GYASFPWFVQLHVHKRSWEMA-NH2 (X) (SEQ ID NO: 223). Optionally, the peptide comprises or consists of the amino acid sequence of formula (VIII)-(IX) as defined herein. As used herein, "at least 60% identity" and similar terms encompass any integer from, e.g., 60%, to 100%, such as 60%, 61%, 62%, and the like. Also, the term "at least [percentage] identity" encompasses any percentage that is greater than or equal to the number of identical amino acids divided by the total number of amino acids of the peptide of the invention ([at least percentage identity]≥[number of identical amino acids]/[total number of amino acids of the peptide of the invention]).

The invention also includes a peptide comprising or consisting of the amino acid sequence selected from the group consisting of SEQ ID NOs: 2001-2498 (e.g., a peptide comprising or consisting of the amino acid sequence selected from the group consisting of SEQ ID NOs: 2001-2296 and 2498 (such as SEQ ID NOs: 2001-2126, 2128-2296, or 2498) and/or selected from the group consisting of SEQ ID NOs: 2297-2497 (such as SEQ ID NOs: 2298-2497)). The invention further provides a peptide comprising or consisting of the amino acid sequence selected from the group consisting of SEQ ID NOs: 3001-3108 (e.g., a peptide comprising or consisting of the amino acid sequence selected from the group consisting of SEQ ID NOs: 3001-3064 (such as SEQ ID NOs: 3001-3048, 3051-3053, 3055, or 3057-3064) and/or selected from the group consisting of SEQ ID NOs: 3065-3084 (such as SEQ ID NOs: 3066-3084) and/or selected from the group consisting of SEQ ID NOs: 3085-3108).

The peptide of SEQ ID NOs: 1-7 also, in some aspects, comprises one or more amino acids attached at the N- or C-terminus of SEQ ID NOs: 1-7. For example, the invention includes a peptide comprising or consisting of the amino acid sequence of JBT0047, JBT0051, JBT0055, JBT0131, JBT0132, JBT0133, JBT0155, JBT0158, JBT0162, JBT0163, JBT0164, JBT0166, JBT0169, JBT0170, JBT0171, JBT0174, JBT0175, or JBT0293, all of which comprise the amino acid sequence of SEQ ID NO: 1. Exemplary peptides comprising the amino acid sequence of SEQ ID NO: 2 include peptides comprising or consisting of the amino acid sequence of JBT0294, JBT0295, JBT0296, JBT0297, JBT0298, JBT0299, JBT0300, JBT0301, JBT0302, JBT0303, JBT0304, JBT0305, JBT0306, JBT0307, JBT0308, JBT0309, JBT0310, or JBT0311. Exemplary peptides comprising the amino acid sequence of SEQ ID NO: 3 comprise or consist of the amino acid sequence of JBT0049, JBT0053, JBT0057, JBT0190, JBT0193, or JBT0197. The invention further includes a peptide comprising or consisting of the amino acid sequence of JBT0050, JBT0054, JBT0058, JBT0129, JBT0130, JBT0205, JBT0208, JBT0211, JBT0212, JBT0217, JBT0218, or JBT0219, all of which include the amino acid sequence of SEQ ID NO: 4. Exemplary peptides comprising SEQ ID NO: 5 include those comprising or consisting of the amino acid sequence of JBT0101, JBT0052, JBT0103, JBT0178, or JBT0182. The invention additionally includes a peptide comprising or consisting of the amino acid sequence of JBT0120, JBT0124, JBT0247, JBT0248, JBT0251, or JBT0252, each of which include the amino acid sequence of SEQ ID NO: 6. A peptide including the amino acid sequence of SEQ ID NO: 7, e.g., a peptide comprising or consisting of the amino acid sequence of JBT0122, JBT0126. JBT0221, JBT0224, JBT0225, JBT0226, JBT0228, JBT0232, or JBT0233, also provided by the invention. The peptides described herein are set forth in Table 5 of Example 1 and in FIGS. 12-18.

The invention further includes a TFPI-binding peptide comprising the structure of formula (XI): X4001-Q-X4003-X4004-X4005-X4006-X4007-X4008-X4009-X4010-X4011-X4012-X4013-X4014-R-X4016-X4017-X4018-X4019-X4020 (XI) (SEQ ID NO: 3151). With respect to formula (XI), X4001 is an amino acid selected from the group consisting of F, L, M, Y, 1Ni, Thi, Bta, and Dopa (e.g., F, Y, 1Ni, Bta, or Dopa); X4003 is an amino acid selected from the group consisting of C, D, E, M, Q, R, S, T, Ede(O), and Cmc (e.g., D, E, or S); X4004 is an amino acid selected from the group consisting of Aib, E, G, I, K, L, M, P, R, W, and Y (e.g., K); X4005 is an amino acid selected from the group consisting of a, A, Aib, C, D, d, E, G, H, K, k, M, N, Nmg, p, Q, R, NpropylG, aze, pip, tic, oic, hyp, nma, Ncg, Abg, Apg, thz, and dtc (e.g., p, Nmg, NpropylG, aze, pip, tic, oic, or hyp); X4006 is an amino acid selected from the group consisting of A, C, C(NEM), D, E, G, H, K, M, N, Q, R, S, V, Cit, C(Acm), Nle, I, Ede(O), Cmc, Ed, Eea, Eec, Eef, Nif, and Eew (e.g., C, E, K, R, S, V, C(Acm), Nle, C(NEM), I, or Cit); X4007 is an amino acid selected from the group consisting of I, V, T, Chg, Phg, and Tle (e.g., V or Tle); X4008 is an amino acid selected from the group consisting of F, H, 1Ni, 2Ni, Pmy, and Y (e.g., H, 1Ni, 2Ni, or Pmy); X4009 is an amino acid selected from the group consisting of Aib, V, Chg, Phg, Abu, Cpg, Tle, and L-2-amino-4,4,4-trifluorobutyric acid (e.g., V, Abu, or Tle); X4010 is an amino acid selected from the group consisting of A, C, D, d, E, F, H, K, M, N, P, Q, R, S, T, V, W, Y, Nmd, and C(NEM) (e.g., D, P, C or T); X4011 is an amino acid selected from the group consisting of A, a, G, p, Sar, c, and hcy (e.g., G, a, c, hcy, or Sar); X4012 is an amino acid selected from the group consisting of Y, Tym, Pty, Dopa, and Pmy (e.g., Y); X4013 is an amino acid selected from the group consisting of C, F, 1Ni, Thi, and Bta (e.g., F, 1Ni, or Bta); X4014 is an amino acid selected from the group consisting of A, Aib, C, C(NEM), D, E, K, L, M, N, Q, R, T, V, and Hcy (e.g., Aib, C, E, or Hcy); X4016 is an amino acid selected from the group consisting of L, Hcy, Hle, and Aml; X4017 is an amino acid selected from the group consisting of A, a, Aib, C, c, Cha, Dab, Eag, Eew, H, Har, Hci, Hle, I, K, L, M, Nle, Nva, Opa, Orn, R, S, Deg, Ebc, Eca, Egz, Aic, Apc, and Egt (e.g., A, Aib, C, c, Aic, Eca, or Deg); X4018 is an amino acid selected from the group consisting of A, Aib, Hcy, hcy, C, c, L, Nle, M, N, and R (e.g., A, Aib, C, c, L, or Hcy); X4019 is an amino acid selected from the group consisting of K, R, and Har (e.g., K); and X4020 is an amino acid selected from the group consisting of K, L, Hcy, and Aml (e.g., L, Aml, and Hcy).

The TFPI-binding peptide of formula (XI) does not comprise the structure of formula (XII): X5001-Q-X5003-X5004-X5005-X5006-I/V-X5008-Aib/V-X5010-G-Y-X5013-X5014-R-L-X5017-X5018-K-K/L (XII) (SEQ ID NO: 3152). In formula (XII), X5001 is an amino acid selected from the group consisting of F, L, M, and Y; X5003 is an amino acid selected from the group consisting of C, D, E, M, Q, R, S, and T; X5004 is an amino acid selected from the group consisting of E, G, I, K, L, M, P, R, W, and Y; X5005 is an amino acid selected from the group consisting of a, A, Aib, C, D, d, E, G, H, K, k, M, N, Nmg, Q, R, and p; X5006 is an amino acid selected from the group consisting of A, C, D, E, G, H, K, M, N, Q, R, S, and V; X5008 is an amino acid selected from the group consisting of F, H, and Y; X5010 is an amino acid selected from the group consisting of A, C, D, E, F, H, D, M, N, P, Q, R, S, T, V, W, and Y; X5013 is an amino acid selected from the group consisting of Aib, C, and F; X5014 is an amino acid selected from the group consisting of A, Aib, C, D, E, K, L, M, N, Q, R, T, and V; X5017 is an amino acid selected from the group consisting of A, Aib, C, Cha, Dab, Eag, Eew, H, Har, Hci, Hle, I, K, L, M, Nle, Nve, Opa, Orn, R, and S; and X5018 is an amino acid selected from the group consisting of A, C, L, M, N, and R.

In one aspect, the TFPI-binding peptide described herein further comprises N-terminal amino acid(s) or moieties. For example, the TFPI-binding peptide of formula (XI) further comprises N-terminal amino acid(s) and/or moieties linked to X4001, or X6001 and/or X7001 of formulas (XIII) and (XIV) (described below) are linked to N-terminal amino acid(s) or moieties. The N-terminal amino acid(s) and/or moieties are optionally selected from the group consisting of FAM-Ttds, a proline-glutamate tag ("PE"), Palm, 2-phenyl acetyl, 3-phenyl propionyl, 2-(naphth-2-yl) acetyl, hexanoyl, 2-methyl propionyl, 3-methyl butanoyl, 2-naphthylsulfonyl, acetyl, Con, Con(Meox), AOA, Oxme-AOA, Meox-Lev, levulinic acid (Lev), and pentynoic acid (Pyn), and 1-naphthylsulfonyl. Alternatively or in addition, the TFPI-binding peptide (e.g., the TFPI-binding peptide of formula (XI), formula (XIII), and/or formula (XIV)) further comprises one or more amino acid(s) and/or moieties linked to the C-terminal amino acid (e.g., X4020, X6020, or X7022 or X7023). The C-terminal amino acid(s) and/or moieties are optionally selected from the group consisting of C, c, C(NEM), K(Ttds-maleimidopropionyl(EtSH)), FA19205, FA19204, FA19203, FA03202, K(Ttds-maleimid), K(AOA), Cea, and amide. Alternatively, the C-terminal amino acid(s) and/or moieties also are selected from the group consisting of Eag, Con, Con(Meox), Hly, K, Orn, Dab, Dap, Hcy, Pen, K(Myr), K(Ttds-Myr), K(Ttds-Palm), K(Ttds-Ac), K(Ttds-γGlu-Myr), K(AlbuTag), and K(4PBSA). In the context of formula (XI), C-terminal amino acid(s) and/or moieties are designated herein as X4021. In the context of formulas (XIII) and (XIV), C-terminal amino acid(s) and/or moieties are designated as X6021 and X7024, respectively.

In one embodiment, the peptide comprises a cyclic structure formed between X4018 and X4021. In this regard, X4018 is optionally C or c, and X4021 is optionally Cea. In another embodiment, the peptide comprises a cyclic structure formed between X4011 and X4014. In this regard, X4011 is optionally c or hcy, and X4014 is optionally C or Hcy.

The invention also includes a peptide consisting of the amino acid sequence selected from the group consisting of SEQ ID NOs: 4022, 4024, 4032, 4036-4047, 4049-4078, 4086-4097, 4100-4127, 4129-4170, 4173-4195, 4200-4214, 4217-4225, 4228, 4230, 4231, 4238, and 4239, as well as a peptide consisting of the amino acid sequence selected from the group consisting of SEQ ID NOs: 1294-1336, 4002, 4013, 4021, 4023, 4025-4031, 4033-4035, 4048, 4079-4085, 4098, 4099, 4128, 4171, 4172, 4196-4199, 4215, 4216, 4226, 4277, 4229, 4232, and 4233.

In certain embodiments, the peptide of the invention comprises or consists of the amino acid sequence of JBT0047, JBT0049, JBT0101, JBT0120, or JBT0122 or any of the inventive peptides described herein (e.g., a peptide comprising or consisting of the amino acid sequence of any one of SEQ ID NOs: 1-3108, such as a peptide comprising or consisting of the amino acid sequence of any one of SEQ ID NOs: 8-741, 744-968, 971-978, 1001-1210, 1213-1289, 1290-1293, 2001-2126, 2128-2296, 2298-2498, 3001-3048, 3051-3053, 3055, 3057-3064, and 3067-3108; a peptide comprising or consisting of the amino acid sequence of any one of SEQ ID NOs: 4022, 4024, 4032, 4036-4047, 4049-4078, 4086-4097, 4100-4127, 4129-4170, 4173-4195, 4200-4214, 4217-4225, 4228, 4230, 4231, 4238, and 4239; or a peptide comprising or consisting of the amino acid sequence selected from the group consisting of SEQ ID NOs: 1294-1336, 4002, 4013, 4021, 4023, 4025-4031, 4033-4035, 4048, 4079-4085, 4098, 4099, 4128, 4171, 4172, 4196-4199, 4215, 4216, 4226, 4277, 4229, 4232, and 4233), or a peptide comprising or consisting of the amino acid sequence selected from the group consisting of SEQ ID NOs: 1337-1355, 3146-3154 and 4240-4268, or a variant of any of the foregoing. By "variant" is meant a peptide comprising one or more amino acid substitutions, amino acid deletions, or amino acid additions to a parent amino acid sequence. Variants include, but are not limited to, peptides having an amino acid sequence that is at least 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to any of the amino acid sequences provided herein while retaining the ability to bind TFPI and/or inhibit TFPI activity. In one embodiment, the peptide comprises or consists of the amino acid sequence of JBT0132, JBT0303, JBT0193, JBT0178, JBT0120, or JBT0224.

In one aspect, the peptide of the invention consists of 40 amino acids or less, such as 35 amino acids or less. Optionally, the peptide of the invention consists of 25 amino acids or less, or 10 amino acids or less. In various embodiments, the peptide comprises 15-35 amino acid residues (e.g., 15, 16, 17, 18, 19, 20, 21, 22, 23, 24, 25, 26, 27, 28, 29, 30, 31, 32, 33, 34, or 35 amino acid residues). However, it is also contemplated that a peptide described herein comprising one or more deletions is suitable in the context of the invention so long as the peptide binds TFPI and, optionally, blocks TFPI inhibition of the coagulation cascade. In some aspects, amino acids are removed from within the amino acid sequence, at the N-terminus, and/or at the C-terminus. Such peptide fragments can comprise 3-14 amino acid residues (e.g., 3, 4, 5, 6, 7, 8, 9, 10, 11, 12, 13, or 14 amino acid residues).

Optionally, the peptide of the invention comprises one or more amino acid substitutions (with reference to any of the amino acid sequences provided herein) that do not destroy the ability of the peptide to bind and/or inhibit TFPI. For instance, peptides comprising or consisting of the amino acid sequence selected from the group consisting of JBT0294, JBT0295, JBT0296, JBT0297, JBT0298, JBT0299, JBT0300, JBT0301, JBT0302, JBT0303, JBT0304, JBT0305, JBT0306, JBT0307, JBT0308, JBT0309, JBT0310, or JBT0311 are substitutional mutants of the amino acid sequence of JBT0293 (the amino acid sequence of SEQ ID NO: 1 directly linked to a phenylalanine residue at the N-terminus and a lysine reside at the C-terminus) (see FIG. 4).

Amino acid substitutions include, but are not limited to, those which: (1) reduce susceptibility to proteolysis, (2) reduce susceptibility to oxidation, (3) alter binding affinities, and/or (4) confer or modify other physiochemical or functional properties on a peptide. In one aspect, the substitution is a conservative substitution, wherein an amino acid residue is replaced with an amino acid residue having a similar side chain. Families of amino acid residues having similar side chains have been defined within the art, and include amino acids with basic side chains (e.g., lysine, arginine, and histidine), acidic side chains (e.g., aspartic acid and glutamic acid), uncharged polar side chains (e.g., glycine, asparagine, glutamine, serine, threonine, tyrosine, and cysteine), nonpolar side chains (e.g., alanine, valine, leucine, isoleucine, proline, phenylalanine, methionine, and tryptophan), beta-branched side chains (e.g., threonine, valine, and isoleucine) and aromatic side chains (e.g., tyrosine, phenylalanine, tryptophan, and histidine). It will be appreciated, however, that a practitioner is not limited to creating conservative substitutions so long as the resulting peptide retains the ability to downregulate, in whole or in part, TFPI activity. The invention also embraces TFPI-binding peptides (e.g., TFPI-inhibitory peptides) comprising atypical, non-naturally occurring amino acids, which are well known in the art. Exemplary non-naturally occurring amino acids include ornithine, citrulline, hydroxyproline, homoserine, phenylglycine, taurine, iodotyrosine, 2,4-diaminobutyric acid, α-amino isobutyric acid, 4-aminobutyric acid, 2-amino butyric acid, γ-amino butyric acid, 2-amino isobutyric acid, 3-amino propionic acid, norleucine, norvaline, sarcosine, homocitrulline, cysteic acid, t-butylglycine, t-butylalanine, phenylglycine, cyclohexylalanine, β-alanine, a fluoro-amino acid, a 3-methyl amino acid, β-C-methyl amino acid, a N-methyl amino acid, 2-amino-isobutyric acid, β-homoglutamatic acid, β-homophenylalanine, β-homolysine, β-homoleucine, β-homoasparagine, β-homoglutamine, β-homoarginine, β-homoserine, β-homotyrosine, β-homoaspartic acid, β-homovaline, β-homoasparagin, (S)-cyclohexylalanine, (S)-citrullin, (S)-2,4-diaminobutyric acid, (S)-2,4-diaminobutyric acid, (S)-diaminopropionic acid, (S)-2-propargylglycine, (S)—N(omega)-nitro-arginine, L-homophenylalanine, S)-homo-arginine, (S)-homo-citrulline, (S)-homo-cysteine, (S)-2-amino-5-methyl-hexanoic acid, (S)-homo-lysine, (S)-norleucine, (S)—N-methylalanine, (S)—N-methyl-aspartic acid, (S)—N-methyl-glutamic acid, (S)—N-methyl-phenylalanine, N-methyl-glycine, (S)—N-methyl-lysine, (S)—N-methyl-leucine, (S)—N-methyl-arginine, (S)—N-methyl-serine, (S)—N-methyl-valine, (S)—N-methyl-tyrosine, (S)-2-amino-pentanoic acid, (S)-2-pyridyl-alanine, (S)-ornithine, L-phenylglycin, 4-phenyl-butyric acid and selenomethionine. The individual amino acids may have either L or D stereochemistry when appropriate, although the L stereochemistry is typically employed for all of the amino acids in the peptide.

The invention further includes TFPI-binding peptide (e.g., TFPI-inhibitory peptide) variants comprising one or more amino acids inserted within an amino acid sequence provided herein and/or attached to the N-terminus or C-terminus. In one aspect, the peptide further comprises one or more amino acids that facilitate synthesis, handling, or use of the peptide, including, but not limited to, one or two lysines at the N-terminus and/or C-terminus to increase solubility of the peptide. Suitable fusion proteins include, but are not limited to, proteins comprising a TFPI-binding peptide (e.g., TFPI-inhibitory peptide) linked to one or more polypeptides, polypeptide fragments, or amino acids not generally recognized to be part of the protein sequence. In one aspect, a fusion peptide comprises the entire amino acid sequences of two or more peptides or, alternatively, comprises portions (fragments) of two or more peptides. In addition to all or part of the TFPI-binding peptides (e.g., TFPI-inhibitory peptides) described herein, a fusion protein optionally includes all or part of any suitable peptide comprising a desired biological activity/function. Indeed, in some aspects, a TFPI-binding peptide (e.g., TFPI-inhibitory peptide) is operably linked to, for instance, one or more of the following: a peptide with long circulating half life, a marker protein, a peptide that facilitates purification of the TFPI-binding peptide (e.g., TFPI-inhibitory peptide), a peptide sequence that promotes formation of multimeric proteins, or a fragment of any of the foregoing. Suitable fusion partners include, but are not limited to, a His tag, a FLAG tag, a strep tag, and a myc tag. Optionally, the TFPI-binding peptide (e.g., TFPI-inhibitory peptide) is fused to one or more entities that enhance the half life of the peptide. Half life can be increased by, e.g., increasing the molecular weight of the TFPI-binding peptide to avoid renal clearance and/or incorporating a ligand for the nFc receptor-mediated recycling pathway. In one embodiment, the TFPI-binding peptide is fused to or chemically conjugated to (as described further below) an albumin polypeptide or a fragment thereof (e.g., human serum albumin (HSA) or bovine serum albumin (BSA)). The albumin fragment comprises 10%, 25%, 50%, or 75% of the full length albumin protein. Alternatively or in addition, the TFPI-binding peptide comprises an albumin binding domain or fatty acid that binds albumin when administered in vivo. An example of an albumin binding domain is "albu-tag," a moiety derived from on 4-(p-iodophenyl)-butanoic acid (Dumelin et al., *Angew Chem Int Ed Engl* 47:3196-3201 (2008)). Other suitable fusion partners include, but are not limited to, a proline-alanine-serine multimer (PASylation) and an antibody or fragment thereof (e.g., an Fc portion of an antibody).

In one embodiment, two or more TFPI-binding peptides are fused together, linked by a multimerization domain, or attached via chemical linkage to generate a TFPI-binding peptide (e.g., TFPI-inhibitory peptide) complex. The TFPI-binding peptides may be the same or different. Thus, the invention provides a homo-dimer (i.e., a dimer comprising two identical TFPI-binding peptides), a homo-multimer (i.e., a complex comprising three or more identical TFPI-binding peptides), a hetero-dimer (i.e., a dimer comprising two different TFPI-binding peptides), and hetero-multimer (i.e., a complex comprising three or more TFPI-binding peptides, wherein at least two of the TFPI-binding peptides are different) comprising or consisting of any of the peptides described herein, optionally attached by one or more linkers.

In this regard, the invention provides a peptide complex comprising a first peptide and a second peptide. Any of the peptides described herein are suitable subunits (e.g., first peptide or second peptide) for the peptide complex. In some embodiments, the peptide complex comprises 25-100 amino acids, e.g., 30-80 amino acids, 30-60 amino acids, or 30-50 amino acids. The first peptide and the second peptide may bind different regions (epitopes) of human TFPI and, optionally, the peptide complex inhibits two or more TFPI functions, such as, but not limited to, TFPI binding to FXa and TFPI binding to FVIIa. The level of inhibition of at least one TFPI (e.g., TFPI-1) activity mediated by the peptide complex is greater than the level of inhibition achieved by the first peptide or the second peptide, alone or in combination, in various embodiments of the invention. The different regions (epitopes) on TFPI may be on the same TFPI polypeptide, or on different TFPI polypeptides. The functional characteristics and therapeutic and diagnostic applications of monomeric TFPI-binding peptides described herein also are applicable to the peptide complexes described herein. Similarly, descriptions of modifications to monomeric TFPI-binding peptides also relate to peptide complexes.

The invention provides a peptide complex comprising a first peptide comprising the structure of formula (XIII):
X6001-X6002-X6003-X6004-X6005-X6006-X6007-X6008-X6009-X6010-X6011-X6012-X6013-X6014-X6015-X6016-X6017-X6018-X6019-X6020 (XIII) (SEQ ID NO: 3153). In formula (XIII), X6001 is an amino acid selected from the group consisting of F, L, M, Y, 1Ni, Thi, Bta, Dopa, Bhf, C, D, G, H, I, K, N, Nmf, Q, R, T, V, and W, such as an amino acid selected from the group consisting of 1Ni, Bta, Dopa, F, L, Y and M;

X6002 is an amino acid selected from the group consisting of Q, G, and K, such as Q;

X6003 is an amino acid selected from the group consisting of C, D, E, M, Q, R, S, T, Ede(O), Cmc, A, Aib, Bhs, F, G, H, I, K, L, N, P, V, W and Y, such as an amino acid selected from the group consisting of D, E, S, M, Q, R, T and C;

X6004 is an amino acid selected from the group consisting of Aib, E, G, I, K, L, M, P, R, W, Y, A, Bhk, C, D, F, H, k, N, Nmk, Q, S, T, and V, such as an amino acid selected from the group consisting of K, Aib, L, P, R, E, G, I, Y, M and W;

X6005 is an amino acid selected from the group consisting of a, A, Aib, C, D, d, E, G, H, K, k, M, N, Nmg, p, Q, R, NpropylG, aze, pip, tic, oic, hyp, nma, Ncg, Abg, Apg, thz, dtc, Bal, F, L, S, T, V, W and Y, such as an amino acid selected from the group consisting of p, Nmg, NpropylG, aze, pip, tic, oic, hyp, a, Aib, D, d, G, H, K, k, N, Q, R, A, E, C and M;

X6006 is an amino acid selected from the group consisting of A, C, C(NEM), D, E, G, H, K, M, N, Q, R, S, V, Cit, C(Acm), Nle, I, Ede(O), Cmc, Ed, Eea, Eec, Eef, Nif, Eew, Aib, Btq, F, I, L, T, W and Y, such as an amino acid selected from the group consisting of C, E, K, R, S, V, C(Acm), Nle, C(NEM), I, Cit, A, D, G, H, N, Q and M;

X6007 is an amino acid selected from the group consisting of I, V, T, Chg, Phg, Tle, A, F, G, I, K, L, Nmv, P, Q, S, W and Y, such as Tle, V or I;

X6008 is an amino acid selected from the group consisting of F, H, 1Ni, 2Ni, Pmy, Y, and W, such as an amino acid selected from the group consisting of H, 1Ni, 2Ni, Pmy, F and Y;

X6009 is an amino acid selected from the group consisting of Aib, V, Chg, Phg, Abu, Cpg, Tle, L-2-amino-4,4,4-trifluorobutyric acid, A, f, I, K, S, T and V, such as V, Abu or Tle;

X6010 is an amino acid selected from the group consisting of A, C, D, d, E, F, H, K, M, N, P, Q, R, S, T, V, W, Y, Nmd, C(NEM), Aib, G, I, L and Nmf, such as an amino acid selected from the group consisting of D, P, C, T, A, E, K, M, N, Q, R, F, H, S, V, W and Y;

X6011 is an amino acid selected from the group consisting of A, a, G, p, Sar, c, hcy, Aib, C, K, G and Nmg, such as G, a, c, hcy or Sar;

X6012 is an amino acid selected from the group consisting of Y, Tym, Pty, Dopa, and Pmy, such as Y;

X6013 is an amino acid selected from the group consisting of Aib, C, F, 1Ni, Thi, Bta, A, E, G, H, K, L, M, Q, R, W and Y, such as an amino acid selected from the group consisting of F, 1Ni, Bta and C;

X6014 is an amino acid selected from the group consisting of A, Aib, C, C(NEM), D, E, K, L, M, N, Q, R, T, V, Hcy, Bhe, F, G, H, I, P, S, W and Y, such as an amino acid selected from the group consisting of Aib, C, E, Hcy, A, D, K, L, M, N, Q, R, T, V and Aib;

X6015 is an amino acid selected from the group consisting of R, (omega-methyl)-R, D, E and K, such as R;

X6016 is an amino acid selected from the group consisting of L, Hcy, Hle, and Aml, such as an amino acid selected from the group consisting of L, Aml, Hle and Hcy;

X6017 is an amino acid selected from the group consisting of A, a, Aib, C, c, Cha, Dab, Eag, Eew, H, Har, Hci, Hle, I, K, L, M, Nle, Nva, Opa, Orn, R, S, Deg, Ebc, Eca, Egz, Aic, Apc, Egt, (omega-methyl)-R, Bhr, Cit, D, Dap, E, F, G, N, Q, T, V, W and Y, such as an amino acid selected from the group consisting of A, Aib, C, c, Aic, Eca, Deg, Cha, Dab, Dap, Eag, Eew, H, Har, Hci, Hle, K, Nle, Nva, Opa, Orn, R, I, L, S and M;

X6018 is an amino acid selected from the group consisting of A, Aib, Hcy, hcy, C, c, L, Nle, M, N, R, Bal, D, E, F, G, H, I, K, Q, S, T, V, W and Y, such as an amino acid selected from the group consisting of A, Aib, C, c, L, Hcy, N, M and R;

X6019 is an amino acid selected from the group consisting of K, R, Har, Bhk and V, such as K; and X6020 is an amino acid selected from the group consisting of K, L, Hcy, Aml, Aib, Bhl, C, F, G, H, I, Nml, Q, R, S, T, V, W and Y, such as an amino acid selected from the group consisting of L, Aml, Hcy and K.

Alternatively, the first peptide comprises the structure of any one of formulas (I)-(IV) and (XI) described herein. The first peptide, in various embodiments, comprises (or consists of) an amino acid sequence selected from the group consisting of SEQ ID NOs: 8-978, 4022, 4024, 4032, 4036-4047, 4049-4078, 4086-4097, 4100-4127, 4129-4170, 4173-4195, 4200-4214, 4217-4225, 4228, 4230, 4231, 4238, 4239, 4002, 4013, 4021, 4023, 4025-4031, 4033-4035, 4048, 4079-4085, 4098, 4099, 4128, 4171, 4172, 4196-4199, 4215, 4216, 4226, 4277, 4229, 4232, and 4233.

The second peptide, in one aspect, comprises the structure of formula (XIV): X7001-X7002-X7003-X7004-X7005-X7006-(XIV) (SEQ ID NO: 3154). In formula (XIV), X7001 is either present or absent, whereby in case X7001 is present it is an amino acid selected from the group consisting of A, C, C(NEM), D, E, F, G, H, I, K, L, P, R, S, T, V and W, such as an amino acid selected from the group consisting of A, D, F, G, H, K, L and S;

X7002 is either present or absent, whereby in case X7002 is present it is an amino acid selected from the group consisting of A, C, C(NEM), D, E, F, G, H, I, K, L, M, P, Q, R, S, T, V, W, and Y, such as an amino acid selected from the group consisting of H, F, M and R;

X7003 is an amino acid selected from the group consisting of A, F, I, K, L, R, S, T, V, W and Y, such as F or Y;

X7004 is an amino acid selected from the group consisting of A, D, E, F, G, I, K, L, R, S, T, V and W, such as K;

X7005 is R or W, such as W;

X7006 is an amino acid selected from the group consisting of F, H, I, K, L, R, V and W, such as F or H;

X7007 is an amino acid selected from the group consisting of Orn, homoK, C, Hcy, Dap and K, such as C or Hcy;

X7008 is an amino acid selected from the group consisting of A, G, R, S and T, such as A, G or S;

X7009 is an amino acid selected from the group consisting of a, A, I, K, L, M, m, Moo, Nle, p, R, Sem and V, such as M, Sem, or V;

X7010 is an amino acid selected from the group consisting of A, G, I, K, L, P, R, S, T and V, such as K, P or R;

X7011 is an amino acid selected from the group consisting of D, E, G, S and T, such as D;

X7012 is an amino acid selected from the group consisting of A, a, D, d, E, e, F, f, G, I, K, k, L, l, M, m, Moo, Nle, nle, P, p, R, r, S, s, Sem, T, t, V, v, W and w, such as an amino acid selected from the group consisting of F, L, l, M and Sem;

X7013 is an amino acid selected from the group consisting of A, C, C(NEM), Con, Con(Meox), D, d, E, e, Eag, F, G, I, K, L, N, R, S, s, T, V and W, such as an amino acid selected from the group consisting of D, G, K and S;

X7014 is an amino acid selected from the group consisting of A, D, E, F, G, I, K, L, M, R, S, T, V and W, such as G;

X7015 is an amino acid selected from the group consisting of A, D, E, F, G, I, K, L, M, Nle, R, S, T, V and W, such as I or T;

X7016 is an amino acid selected from the group consisting of A, D, E, F, I, K, L, M, Moo, Nle, R, S, Sem, T, V, W and Y, such as an amino acid selected from the group consisting of D, F, M, Sem and Y;

X7017 is an amino acid selected from the group consisting of A, D, E, F, G, I, K, L, R, S, T, V, W and Y, such as S or T;

X7018 is an amino acid selected from the group consisting of C and D, such as C;

X7019 is an amino acid selected from the group consisting of A, F, I, L, S, T, V and W, such as A or V;

X7020 is an amino acid selected from the group consisting of F and W, such as W;

X7021 is an amino acid selected from the group consisting of I, L and V, such as V;

X7022 is an amino acid selected from the group consisting of A, D, E, F, G, I, K, L, P, R, S, T, V and W, such as the group consisting of F, L, K, R, P and W;

X7023 is either present or absent, whereby in case X7023 is present it is an amino acid selected from the group consisting of A, C, C(NEM), Con, Con(Meox), D, E, Eag, F, G, I, K, L, R, S, T, V, W and Y, such as an amino acid selected from the group consisting of A, D, F, M, S and Y; and the peptide comprises as a cyclic structure generated by a linkage between X7007 and X7018.

Alternatively, the second peptide comprises the structure of any one of formulas (V)-(VII) described herein. The second peptide, in some embodiments, comprises (or consists of) an amino acid sequence selected from the group consisting of SEQ ID NOs: 1001-1336. While peptides of formula (XIII) and formula (XIV) are referenced herein as first and second peptides of a peptide complex, monomeric peptides having the structure of formula (XIII) or formula (XIV) also are contemplated.

Examples of TFPI-binding peptides that bind different TFPI epitopes include JBT1857, an example of the JBT0047 class of peptides (represented as, e.g., formulas (I)-(IV) and (XI) and examples of which are set forth in FIGS. 32, 62, and 65), and JBT1837, an example of the JBT0120 class of peptides (represented as, e.g., formulas (V)-(VII) and examples of which are set forth in FIG. 34). Thus, in one aspect, the invention provides a peptide complex comprising a peptide subunit (e.g., a first peptide) comprising an amino acid sequence at least 80%, at least 85%, at least 90%, at least 95%, or 100% identical to SEQ ID NO: 178 (JBT1857) or SEQ ID NO: 4261 (JBT2548). Additionally, the invention provides a peptide complex comprising a peptide subunit (e.g., a second peptide) comprising an amino acid sequence at least 80%, at least 85%, at least 90%, at least 95%, or 100% identical to SEQ ID NO: 1044 (JBT1837). Exemplary TFPI-binding peptide dimers include JBT2496 (SEQ ID NO: 4211), JBT2547 (SEQ ID NO: 4260), JBT2521 (SEQ ID NO: 4242), JBT2522 (SEQ ID NO: 4243), JBT2523 (SEQ ID NO: 4244), and JBT2533 (SEQ ID NO: 4250).

In various aspects of the disclosure, the peptide subunits (e.g., first peptide and second peptide) of the peptide complex are fused together directly or are linked by a linker moiety. For example, the first peptide and the second peptide are conjugated together by reacting a nucleophilic reactive moiety on one peptide with an electrophilic reactive moiety on another peptide or by oxidation to form a disulfide. In exemplary embodiments, the first and second peptides are linked by an amide bond, such as an amide bond that forms upon reaction of an amine on one peptide with a carboxyl group on another peptide. It will be appreciated that peptides are optionally derivatized with a derivatizing agent before conjugation.

In some embodiments, the first peptide and the second peptide (and optionally additional peptides) are linked by a linker moiety. Any linker moiety is suitable for use in the context of the peptide complex. The linker moiety, in some aspects of the invention, bridges a distance of about 1 Å to about 100 Å, e.g., about 5 Å to about 80 Å (about 5 Å to about 50 Å), about 10 Å to about 70 Å (about 10 Å to about 60 Å, about 10 Å to about 50 Å, about 10 Å to about 40 Å, or about 10 Å to about 30 Å), in one of its conformations. Thus, the linker is optionally about 1 Å to about 100 Å in length, e.g., about 5 Å to about 50 Å or about 10 Å to about 30 Å in length in one of its conformations. Linkers of greater length (greater than about 100 Å) also are contemplated. For example, biocompatible polymers, optionally having a molecular weight of about 2 kDa to about 60 kDa, also are contemplated for use in the peptide complex. Examples of biocompatible polymers include, but are not limited to, PEG, PSA, proline-alanine-serine multimer, and hydroxyethyl starch.

In one non-limiting example, the linker moiety is a molecule with at least two reactive groups (before conjugation to the first and second peptides) capable of reacting with each of the first peptide and the second peptide. In some embodiments, the linker moiety has only two reactive groups and is bifunctional. The reactive groups are both nucleophilic, both electrophilic, or a combination of nucleophilic and electrophilic reactive groups. Nonlimiting combinations of reactive groups are shown in FIG. 73. The linker moiety may contain structural elements resulting from a chemical ligation, such as, for instance, cystein, oxime, hydrazide, succinimide, thioether, triazole, secondary amine, amide, disulfide. In various embodiments, the linker moiety is attached to the first peptide and/or the second peptide via an oxime, a hydrazide, a succinimide, a thioether, a triazole, a secondary amine, an amide, or a disulfide. Additional description of linker moieties and reactive groups is provided in International Patent Publication No. WO 2011/143209, incorporated herein by reference in its entirety.

Hydrophobic linkers also are suitable for use in the context of the invention. Hydrophobic linkers are known in the art. See, e.g., Bioconjugate Techniques, G. T. Hermanson (Academic Press, San Diego, Calif., 1996), which is incorporated by reference in its entirety. Suitable hydrophobic linker moieties include, for example, 8-hydroxyoctanoic acid and 8-mercaptooctanoic acid. Hydrophilic linker moieties such as, for example, polyalkylene glycol, also are suitable for use in the context of the invention. In some embodiments, the linker moiety comprises a chain of atoms from about 1 to about 60 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble peptide complex.

In one aspect, the linker moiety comprises the structure $Z_{1-20}$, wherein Z is an oligomer building block. Examples of oligomer building blocks include, but are not limited to, an amino acid, hydroxy acid, ethylene glycol, propylene glycol, or a combination of any of the foregoing. For example, the linker moiety is optionally an amino acid, a dipeptide, a tripeptide, or a polypeptide comprising 4-20 amino acids. In some embodiments, Z is G, s, S, a, A, Bal, Gaba, Ahx, Ttds, or a combination of any of the foregoing (such as peptide tenmer comprising A, S, or a combination of A and S). If desired, the linking moiety comprises an amine, ether, thioether, maleimide, disulfide, amide, ester, alkene, cycloalkene, alkyne, trizoyl, carbamate, carbonate, cathepsin B-cleavable, or hydrazone.

The terms "first peptide" and "second peptide" are not meant to imply a particular physical order of the peptides, but merely to distinguish different subunits of the peptide complex. The subunits of the peptide complex may be linked in any of a number of configurations so long as the first peptide and second peptide interact with TFPI. For example, the C-terminus of the first peptide is connected to the N-terminus of the second peptide, the N-terminus of the first peptide is connected to the C-terminus of the second peptide, the N- or C-terminus of the first (or second) peptide is connected to an internal attachment point in the second (or first) peptide, or the first and second peptides are connected via internal attachment points (i.e., attachment points located within the amino acid sequence of the peptide and not at the N- or C-terminus). Exemplary attachment points for a linking moiety in the first peptide of formula (XIII) is the N-terminal amino group, the C-terminal carboxylic acid, X6004, X6006, X60010, or X60014 via an appropriate functional group in the amino acid side chain, such as, but not limited to, amine, carboxylic acid, thiol, alkene, alkyne, azide, carbonyl, aminooxy, hydrazine and halogens. More than one linker may be used, e.g., a first linking moiety is attached at the N-terminus of the first peptide and the C-terminus of the second peptide, and a second linking moiety (which may be the same type of moiety or a different type of moiety) is attached at the C-terminus of the first peptide and attached at the N-terminus of the second peptide. While the discussion of possible configurations refers to the first and second peptides, it will be appreciated that additional peptides may be linked to the first and/or second peptides as described herein.

"Derivatives" are included in the invention and include TFPI-binding peptides that have been chemically modified in some manner distinct from addition, deletion, or substitution of amino acids. In this regard, a peptide of the invention provided herein is chemically bonded with polymers, lipids, other organic moieties, and/or inorganic moieties. Examples of peptide and protein modifications are given in Hermanson, *Bioconjugate Techniques*, Academic Press, (1996). The TFPI-binding peptides described herein optionally comprise a functional group that facilitates conjugation to another moiety (e.g., a peptide moiety). Exemplary functional groups include, but are not limited to, isothiocyanate, isocyanate, acyl azide, NHS ester, sulfonyl chloride, aldehyde, epoxide, oxirane, carbonate, arylating agent, imidoester, carbodiimide, anhydride, alkyl halide derivatives (e.g., haloacetyl derivatives), maleimide, aziridine, acryloyl derivatives, arylating agents, thiol-disulfide exchange reagents (e.g., pyridyl disulfides or TNB thiol), diazoalkane, carboyldiimadazole, N,N'-Disuccinyl carbonate, N-Hydroxysuccinimidyl chloroformate, and hydrazine derivatives. Maleimide is useful, for example, for generating a TFPI-binding peptide that binds with albumin in vivo.

Derivatives are prepared in some situations to increase solubility, stability, absorption, or circulating half life. Various chemical modifications eliminate or attenuate any undesirable side effect of the agent. In one aspect, the invention includes TFPI-binding peptides covalently modified to include one or more water soluble polymer attachments. A water soluble polymer (or other chemical moiety) is attached to any amino acid residue, although attachment to the N- or C-terminus is preferred in some embodiments. Optionally, a polymer is attached to the peptide via one or more amino acids or building blocks that offer functional groups that facilitate polymer attachment. For example, JBT2315 comprises a C-terminal cysteine (position X4021 with respect to formula (XI)), which facilitates the addition of, e.g., a maleimide polyethylene glycol (PEG). Useful polymers include, but are not limited to, PEG (e.g., PEG approximately 40 kD, 30 kD, 20 kD, 10, kD, 5 kD, or 1 kD in size), polyoxyethylene glycol, polypropylene glycol, monomethoxy-polyethylene glycol, dextran, hydroxyethyl starch, cellulose, poly-(N-vinyl pyrrolidone)-polyethylene glycol, propylene glycol homopolymers, a polypropylene oxide/ethylene oxide copolymer, polysialic acid (PSA), polyoxyethylated polyols (e.g., glycerol) and polyvinyl alcohol, as well as mixtures of any of the foregoing. In one aspect, the peptide of the invention is a PEGylated peptide. PEG moieties are available in different shapes, e.g., linear or branched. For further discussion of water soluble polymer attachments, see U.S. Pat. Nos. 4,640,835; 4,496,689; 4,301,144; 4,670,417; 4,791,192; and 4,179,337. Other moieties useful for improving peptide half life or stability are described herein and include, for instance, albumin (optionally modified to allow conjugation to the inventive peptide), fatty acid chains (e.g., C12-C18 fatty acid, such as a C14 fatty acid), an antibody or fragment thereof (e.g., an Fc portion of an antibody), and proline-alanine-serine multimers.

In another aspect, a peptide derivative includes a targeting moiety specific for a particular cell type, tissue, and/or organ. Alternatively, the peptide is linked to one or more chemical moieties that facilitate purification, detection, multimerization, binding with an interaction partner, and characterization of peptide activity. An exemplary chemical moiety is biotin. Other moieties suitable for conjugation to the TFPI-binding peptide of the invention include, but are not limited to, a photosensitizer, a dye, a fluorescence dye, a radionuclide, a radionuclide-containing complex, an enzyme, a toxin, and a cytotoxic agent. Photosensitizers include, e.g., Photofrin, Visudyne, Levulan, Foscan, Metvix, Hexvix®, Cysview™, Laserphyrin, Antrin, Photochlor, Photosens, Photrex, Lumacan, Cevira, Visonac, BF-200 ALA, and Amphinex. If desired, a His tag, a FLAG tag, a strep tag, or a myc tag is conjugated to the peptide.

In addition, in one aspect, the peptides of the invention are acylated at the N-terminal amino acid of the peptide. In another aspect, the peptides of the invention are amidated at the C-terminal amino acid of the peptide. In a still further aspect, the peptides of the invention are acylated at the N-terminal amino acid of the peptide and are amidated at the C-terminal amino acid of the peptide.

Derivatives also include peptides comprising modified or non-proteinogenic amino acids or a modified linker group (see, e.g., Grant, *Synthetic Peptides: A User's Guide*, Oxford University Press (1992)). Modified amino acids include, for example, amino acids wherein the amino and/or carboxyl group is replaced by another group. Non-limiting examples include modified amino acids incorporating thioamides, ureas, thioureas, acylhydrazides, esters, olefines, sulfonamides, phosphoric acid amides, ketones, alcohols, boronic acid amides, benzodiazepines and other aromatic or non-aromatic heterocycles (see Estiarte et al., *Burgers Medicinal Chemistry*, $6^{th}$ edition, Volume 1, Part 4, John Wiley & Sons, New York (2002)). Modified amino acids are often connected to the peptide with at least one of the above mentioned functional groups instead of an amide bond. Non-proteinogenic amino acids include, but are not limited to, β-alanine (Bal), norvaline (Nva), norleucine (Nle), 4-aminobutyric acid (γ-Abu), 2-aminoisobutyric acid (Aib), 6-aminohexanoic acid (ε-Ahx), ornithine (Orn), hydroxyproline (Hyp), taurine, sarcosine, citrulline (Cit), cysteic acid (Coh), cyclohexylalanine (Cha), methioninesulfoxide (Meo), methioninesulfone (Moo), homoserinemethylester (Hsm), propargylglycine (Eag), 5-fluorotryptophan (5Fw), 6-fluorotryptophan (6Fw), 3',4'-dimethoxyphenyl-alanine (Ear), 3',4'-difluorophenylalanine (Dff), 4'-fluorophenyl-alanine (Pff), 1-naphthyl-alanine (1Ni), 1-methyltryptophan (1Mw), penicillamine (Pen), homoserine (Hse), t-butylglycine, t-butylalanine, phenylglycine (Phg), benzothienylalanine (Bta), L-homo-cysteine (Hcy), N-methyl-phenylalanine (Nmf), 2-thienylalanine (Thi), 3,3-diphenylalanine (Ebw), homophenylalanine (Hfe) and S-benzyl-L-cysteine (Ece). The structures of many of the non-proteinogenic amino acids are provided in Table 2. These and other non-proteinogenic amino acids may exist as D- or L-isomers. Examples of modified linkers include, but are not limited to, the flexible linker 4,7,10-trioxa-1,13-tridecanediamine (Ttds), glycine, 6-aminohexanoic acid, beta-alanine (Bal), pentynoic acid (Pyn), and combinations of Ttds, glycine, 6-aminohexanoic acid and Bal.

Homologs of the amino acids constituting the peptides of the invention may be as set forth in Table 3. In any embodiment, one or more amino acids of the TFPI-binding peptide are substituted with a homolog.

TABLE 3

| Amino Acid | Exemplary homologs |
|---|---|
| A | Aib, Bal, Eag, Nma, Abu, G, M, Nva, Nle |
| C | S, A, Hcy, M, L, I, V, Nmc, β-Cysteine |
| D | E, Homoglutamic acid, γ-Hydroxy-glutamic acid, γ-Carboxy-glutamic acid, Nmd, β-Aspartic acid, N, Q, Cysteic acid |
| E | D, Glu, Homoglutamic acid, γ-Hydroxy-glutamic acid, γ-Carboxy-glutamic acid, α-Aminoadipic acid, Nme, β-glutamic acid, Q, N, Cysteic acid |
| F | Hfe, Nmf, β-Phenylalanine, Phg, Bhf, Thienylalanine, Benzothienylalanine, Bromophenylalanine, Iodophenylalanione, Chlorophenylalanine, Methylphenylalanine, Nitrophenylalanine, Y, W, Naphtylalanine, Tic |
| G | A, Nmg |
| H | Nmh, 1-Methylhistidine, 3-Methylhistidine, Thienylalanine |
| I | L, V, Hle, Nva, Nle, β-Isoleucine, Nml, M, Nmi |
| K | Nmk, R, Nmr, β-Lysine, Dab, Dap, β-(1-Piperazinyl)-alanine, 2,6-Diamino-4-hexynoic acid, delta-Hydroxy-lysine, Har, omega-Hydroxy-norarginine, omega-Amino-arginine, omega-Methyl-arginine, β-(2-Pyridyl)-alanine, β-(3-Pyridyl)-alanine, 3-Amino-tyrosine, 4-Amino-phenylalanine, Hci, Cit |
| L | I, V, Hle, Nle, Nva, β-Isoleucine, Nml, M |
| M | I, V, Hle, Nva, R, Har, Nmm, Methioninesulfone |
| N | Nmn, β-Asparagine, Q, Nmq, β-Glutamine, Cys(3-propionic acid amide)-OH, Cys(O2-3-propionic acid amide)-OH |
| P | Azetidine-2-carboxylic acid, Hyp, α-Methyl-methionine, 4-Hydroxy-piperidine-2-carboxylic acid, Pip, α-Methyl-Pro |
| Q | N, Nmn, Nmq, β-Glutamine, Cys(3-propionic acid amide)-OH, Cys(O2-3-propionic acid amide)-OH |
| R | Nmk, K, Nmr, β-Lysine, Dab, Dap, Orn, β-(1-Piperazinyl)-alanine, 2,6-Diamino-4-hexynoic acid, delta-Hydroxy-lysine, Har, omega-Hydroxy-norarginine, omega-Amino-arginine, omega-Methyl-arginine, β-(2-Pyridyl)-alanine, β-(3-Pyridyl)-alanine, 3-Amino-tyrosine, 4-Amino-phenylalanine, Hci, Cit, Hle, L, Nle, M |
| S | T, Hse, β-Serine, C, β-Cyano-alanine, allo-Threonine |
| T | S, Homothreonine, β-Threonine, allo-Threonine |
| V | L, I, Hle, Nva, Nle, β-Valine, Nmv, M, Nmi, Nml |
| W | Nmw, β-Tryptophan, F, Hfe, Nmf, β-Phenylalanine, Phg, Bhf, Thienylalanine, Benzothienylalanine, Bromophenylalanine, Iodophenylalanine, Chlorophenylalanine, Methylphenylalanine, Nitrophenylalanine, Y, Naphtylalanine, Tic |
| Y | Nmy, β-Tyrosine,, F, Hfe, Nmf, β-Phenylalanine, Phg, Bhf, Thienylalanine, Benzothienylalanine, Bromophenylalanine, Iodophenylalanine, Chlorophenylalanine, Methylphenylalanine, Nitrophenylalanine, W, Naphtylalanine, Tic |

Derivatives also include peptides comprising amino acids having modified substituents, such as amino acids modified by halogenation with, e.g., fluorine, chlorine, iodine, or bromine. In some embodiments, the TFPI-binding peptide comprises a halogenated aromatic amino acid, such as phenylalanine.

In some embodiments, the peptide (CO—NH) linkages joining amino acids within the peptide of the invention are reversed to create a "retro-modified" peptide, i.e., a peptide comprising amino acid residues assembled in the opposite direction (NH—CO bonds) compared to the reference peptide. The retro-modified peptide comprises the same amino acid chirality as the reference peptide. An "inverso-modified" peptide is a peptide of the invention comprising amino acid residues assembled in the same direction as a reference peptide, but the chirality of the amino acids is inverted. Thus, where the reference peptide comprises L-amino acids, the "inverso-modified" peptide comprises D-amino acids, and vice versa. Inverso-modified peptides comprise CO—NH peptide bonds. A "retro-inverso modified" peptide refers to a peptide comprising amino acid residues assembled in the opposite direction and which have inverted chirality. A retro-inverso analogue has reversed termini and reversed direction of peptide bonds (i.e., NH—CO), while approximately maintaining the side chain topology found in the reference peptide. Retro-inverso peptidomimetics are made using standard methods, including the methods described in Meziere et al, *J. Immunol.*, 159, 3230-3237 (1997), incorporated herein by reference. Partial retro-inverso peptides are peptides in which only part of the amino acid sequence is reversed and replaced with enantiomeric amino acid residues.

TFPI-binding peptides of the invention (including TFPI inhibitor peptides) are made in a variety of ways. In one aspect, the peptides are synthesized by solid phase synthesis techniques including those described in Merrifield, *J. Am. Chem. Soc.*, 85, 2149 (1963); Davis et al., *Biochem. Intl.*, 10, 394-414 (1985); Larsen et al., *J. Am. Chem. Soc.*, 115, 6247 (1993); Smith et al., *J. Peptide Protein Res.*, 44, 183 (1994); O'Donnell et al., *J. Am. Chem. Soc.*, 118, 6070 (1996); Stewart and Young, *Solid Phase Peptide Synthesis*, Freeman (1969); Finn et al., *The Proteins,* $3^{rd}$ ed., vol. 2, pp. 105-253 (1976); and Erickson et al., *The Proteins,* $3^{rd}$ ed., vol. 2, pp. 257-527 (1976). Alternatively, the TFPI-binding peptide (e.g., the TFPI-inhibitory peptide) is expressed recombinantly by introducing a nucleic acid encoding a TFPI-binding peptide (e.g., a TFPI-inhibitory peptide) into host cells, which are cultured to express the peptide. Such peptides are purified from the cell culture using standard protein purification techniques.

The invention also encompasses a nucleic acid comprising a nucleic acid sequence encoding a peptide of the invention. Methods of preparing DNA and/or RNA molecules are well known in the art. In one aspect, a DNA/RNA molecule encoding a peptide provided herein is generated using chemical synthesis techniques and/or using polymerase chain reaction (PCR). If desired, a peptide coding sequence is incorporated into an expression vector. One of ordinary skill in the art will appreciate that any of a number of expression vectors known in the art are suitable in the context of the invention, such as, but not limited to, plasmids, plasmid-liposome complexes, and viral vectors. Any of these expression vectors are prepared using standard recombinant DNA techniques described in, e.g., Sambrook et al., *Molecular Cloning, a Laboratory Manual*, 2d edition, Cold Spring Harbor Press, Cold Spring Harbor, N.Y. (1989), and Ausubel et al., *Current Protocols in Molecular Biology*, Greene Publishing Associates and John Wiley & Sons, New York, N.Y. (1994). Optionally, the nucleic acid is operably linked to one or more regulatory sequences, such as a promoter, activator, enhancer, cap signal, polyadenylation signal, or other signal involved with the control of transcription or translation.

Any of the peptides (or peptide complexes) of the invention or nucleic acids encoding the peptides also is provided in a composition (e.g., a pharmaceutical composition). In this regard, the peptide (or peptide complex) is formulated with a physiologically-acceptable (i.e., pharmacologically-acceptable) carrier, buffer, excipient, or diluent, as described further herein. Optionally, the peptide is in the form of a physiologically acceptable salt, which is encompassed by the invention. "Physiologically acceptable salts" means any salts that are pharmaceutically acceptable. Some examples of appropriate salts include acetate, hydrochloride, hydrobromide, sulfate, citrate, tartrate, glycolate, and oxalate. If desired, the composition comprises one or more additional pharmaceutically-effective agents.

The peptide provided herein optionally inhibits at least one TFPI-1 (e.g., TFPI-1α or TFPI-1β) activity such as, but not limited to, an activity that downregulates the blood coagulation cascade. Without being bound by any specific mechanism of action, a proposed mechanism of inhibition may involve preventing formation of the quaternary TF-FVIIA- FXA-TFPI complex. The peptide may inhibit binding (competitively or allosterically) of TFPI to FXa (e.g., inhibit binding of TFPI Kunitz domain 2 to Factor Xa or interrupt binding of TFPI Kunitz domain 1 to an exosite of Factor Xa), the TF/FVIIa complex (e.g., inhibit binding of TFPI Kunitz domain 1 to the TF/FVIIa complex), TF alone, and/or FVIIa alone. With TFPI activity diminished, TF and FVIIa are free to activate FX which, in turn, enhances conversion of prothrombin to thrombin. Surprisingly, in one embodiment, the peptide of the invention that binds Kunitz domain 1 interferes with TFPI-mediated inhibition of FXa. Thus, the invention provides a method of, e.g., inhibiting TFPI-mediated down-regulation of the extrinsic and/or common pathway of the coagulation cascade and/or enhancing FXa-mediated conversion of prothrombin to thrombin, by administering to a subject a peptide described herein that binds Kunitz domain 1.

In one aspect, the peptide of the invention exhibits TFPI antagonistic activity in model and/or plasmatic systems. An exemplary model system for determining TFPI-inhibitory activity is the extrinsic tenase assay, which tests the ability of candidate peptides to restore extrinsic complex-mediated FX activation in the presence of TFPI (which is a natural inhibitor of the FX activation reaction) (see, e.g., Lindhout et al., Thromb. Haemost., 74, 910-915 (1995)). Another model system for characterizing TFPI-inhibitory activity is the FXa inhibition assay, wherein FXa activity is measured in the presence of TFPI (see Sprecher et al., PNAS, 91, 3353-3357 (1994)). The extrinsic tenase assay and the FXa inhibition assay are further described in Example 3. Optionally, the peptide of the invention enhances FX activation in the presence of TFPI with a half maximal effective concentration ($EC_{50}$) of less than or equal to $1\times10^{-4}$M, less than or equal to $1\times10^{-5}$M, less than or equal to $1\times10^{-6}$M, or less than or equal to $1\times10^{-7}$M.

In one aspect, TFPI-antagonist activity is characterized in a plasma-based assay. Thrombin formation is triggered in plasma substantially lacking FVIII or FIX activity (e.g., the residual coagulation factor activity is lower than 1%) in the presence of a candidate peptide. Thrombin formation can be detected using a fluorogenic or chromogenic substrate, as described in Example 4. A system for measuring thrombin activity is provided by Thrombinoscope BV (Maastricht, The Netherlands). Prothrombin conversion is measured using, e.g., a Thrombograph™ (Thermo Scientific, Waltham, Mass.), and the resulting data is compiled into a Calibrated Automatic Thrombogram generated by Thrombinoscope™ software available from Thrombinoscope BV. In certain embodiments, the TFPI-inhibitory peptide increases the amount of peak thrombin generated during the assay and/or decreases the time required to achieve peak thrombin formation. For example, the peptide improves TFPI-regulated thrombin generation in the absence of FVIII (e.g., in FVIII-depleted plasma) to at least 1% of the level of TFPI-dependent thrombin generation in normal plasma. Generally, normal (unafflicted) plasma contains about 0.5 U/mL to about 2 U/mL Factor VIII. Accordingly, in some instances, a TFPI-binding peptide (e.g., TFPI-inhibitory peptide) will enhance thrombin formation in the absence of FVIII to at least about 1% of that observed in the presence of 0.5 U/mL to 2 U/mL FVIII. In further embodiments, the peptide enhances thrombin formation in the absence of Factor VIII to at least about 2%, at least about 3%, at least about 5%, at least about 7%, or at least about 10% of the level of thrombin formation in normal plasma, i.e., in the presence of physiological levels of Factor VIII. In various aspects, the peptide is administered to an animal model of thrombin deficiency or hemophilia to characterize TFPI inhibitory activity in vivo. Such in vivo models are known in the art and include for example, mice administered anti-FVIII antibodies to induce hemophilia A (Tranholm et al., Blood, 102, 3615-3620 (2003)); coagulation factor knock-out models such as, but not limited to, FVIII knock-out mice (Bi et al., Nat. Genet., 10(1), 119-121 (1995)) and FIX knock-out mice (Wang et al., PNAS, 94(21), 11563-66 (1997)); induced hemophilia-A in rabbits (Shen et al., Blood, 42(4), 509-521 (1973)); and Chapel Hill HA dogs (Lozier et al., PNAS, 99, 12991-12996 (2002)).

Various peptides bind TFPI from any source including, but not limited to, mouse, rat, rabbit, dog, cat, cow, horse, pig, guinea pig, and primate. In one embodiment, the peptide binds human TFPI. Optionally, the TFPI-binding peptide (e.g., TFPI-inhibitory peptide) binds TFPI from more than one species (i.e., the peptide is cross-reactive among multiple species). In certain aspects, the peptide binds TFPI with a dissociation constant ($K_D$) of less than or equal to $1\times10^{-4}$M, less than or equal to $1\times10^{-5}$M, less than or equal to $1\times10^{-6}$M, or less than or equal to $1\times10^{-7}$M. Affinity may be determined using, for example and without limitation, any one, two, or more of a variety of techniques, such as affinity ELISA assay, a competitive ELISA assay, and/or surface plasmon resonance (BIAcore™) assay. When characterized using a competitive ($IC_{50}$) ELISA assay, the peptide of the invention optionally demonstrates an $IC_{50}$ of less than or equal to about 50,000 nM. For example, the peptide demonstrates an $IC_{50}$ of less than or equal to about 10,000 nM, such as an $IC_{50}$ of less than or equal to about 5,000 nM, less than or equal to about 1,000 nM, or less than or equal to about 500 nM. In one aspect, the peptide demonstrates an $IC_{50}$ of less than or equal to about 250 nM, less than or equal to about 100 nM, less than or equal to about 50 nM, or less than or equal to about 10 nM. Exemplary peptides and their $IC_{50}$ values are provided in FIGS. 32-39; in some instances, the peptides are classified into Groups A, B, C, D, E, F, and G (see Table 4 in Example 1) based on their $IC_{50}$ values. In various aspects, the invention provides peptides falling within Groups A, B, C, D, E, F, and/or G as defined in Table 4. Affinity may also be determined by a kinetic method or an equilibrium/solution method. Such methods are described in further detail herein or known in the art.

Another suitable assay for characterizing the inventive peptides is a $k_{off}$ assay, which examines a peptide's release from TFPI. The $k_{off}$ assay result is not the dissociation rate constant, but a percentage of competitor peptide blocked from TFPI binding by a test peptide after an incubation period with TFPI. An exemplary $k_{off}$ assay includes the following steps: 1) incubation of a TFPI-coated microtiter plate with an amount of test peptide resulting in approximately 90% TFPI occupation; 2) removal of unbound test peptide; 3) addition of a biotinylated tracer (i.e., competitor) peptide that competes with the test peptide for binding to TFPI; 4) incubation for a period of time during which binding sites released by the test peptide is occupied by the tracer; 5) removal of unbound tracer and test peptide; and 6) detection of bound tracer by a chromogenic reaction using streptavidin-horseradish peroxidase conjugate. The resulting signal is indicative of binding sites freed by the test peptide. A test peptide that does not dissociate from TFPI during the incubation period yields a weaker signal compared to an analyte that dissociates completely.

As with all binding agents and binding assays, one of skill in the art recognizes that the various moieties to which a binding agent should not detectably bind in order to be biologically (e.g., therapeutically) effective would be exhaustive and impractical to list. Therefore, the term "specifically binds" refers to the ability of a peptide to bind TFPI with greater affinity than it binds to an unrelated control protein that is not TFPI. For example, the peptide may bind to TFPI with an affinity that is at least, 5, 10, 15, 25, 50, 100, 250, 500, 1000, or 10,000 times greater than the affinity for a control protein. In some embodiments, the peptide binds TFPI with greater affinity than it binds to an "anti-target," a protein or other naturally occurring substance in humans to which binding of the peptide might lead to adverse effects. Several classes of peptides or proteins are potential anti-targets. Because TFPI-inhibitory peptides exert their activity in the blood stream and/or at the endothelium, plasma proteins represent potential anti-targets. Proteins containing Kunitz domains (KDs) are potential anti-targets because KDs of different proteins share a significant similarity. Tissue Factor Pathway Inhibitor-2 (TFPI-2) is highly similar to TFPI-1α and, like TFPI-1α, contains KDs (Sprecher et al., PNAS, 91, 3353-3357 (1994)). Thus, in one aspect, the peptide of the invention binds to TFPI with an affinity that is at least 5, 10, 15, 25, or 50 times greater than the affinity for an anti-target, such as TFPI-2.

Optionally, the TFPI-binding peptide demonstrates one or more desired characteristics described herein, and the amino acid sequence of a peptide can be modified to optimize binding, stability, and/or activity, if desired. An exemplary TFPI-binding peptide binds TFPI with a $K_D$ of less than or equal to 20 nM and/or exhibits a binding affinity for TFPI that is at least 100 times greater than the binding affinity for an anti-target. Alternatively or in addition, the TFPI-binding peptide enhances FX activation in the presence of TFPI with an $EC_{50}$ (as measured using any suitable assay, such as the assays described here) of less than or equal to 50 nM and/or enhances thrombin formation in the absence of Factor VIII to at least about 20% (e.g., 40%) of the level of thrombin formation in plasma containing physiological levels of Factor VIII. Alternatively or in addition, the TFPI-binding peptide achieves a desired level of plasma stability (e.g., 50% or more of a dose remains in plasma after 12 hours) and/or demonstrates a desired half life in vivo (e.g., at least two, three, four, five, six, seven, eight, nine, or ten hours). Alternatively or in addition, the TFPI-binding peptide exhibits a desired level of bioavailability, such as a desired level of bioavailability following subcutaneous administration (e.g., greater than or equal to 5%, 10%, 15%, 20%, 25%, 30%, or 50%) and/or demonstrates a desired level of TFPI-inhibitory activity at a given dose in vivo.

The invention further includes a method of inhibiting TFPI-1. The method comprises contacting TFPI with a TFPI-binding peptide as described herein. Any degree of TFPI-activity inhibition is contemplated. For example, a TFPI-binding peptide (e.g., TFPI-inhibitory peptide) reduces TFPI-inhibition of the extrinsic pathway at least about 5% (e.g., at least about 10%, at least about 25%, or at least about 30%). In some embodiments, the TFPI-binding peptide (e.g., TFPI-inhibitory peptide) reduces TFPI activity within the extrinsic pathway at least about 50%, at least about 75%, or at least about 90% compared to TFPI activity in the absence of the peptide.

In one aspect of the invention, TFPI-binding peptides are used to detect and/or quantify TFPI in vivo or in vitro. An exemplary method of detecting and/or quantifying TFPI in a sample comprises (a) contacting a sample with a TFPI-binding peptide of the invention, and (b) detecting binding of the TFPI-binding peptide to TFPI.

The invention further includes a method for targeting biological structures (including, but not limited to, cell surfaces and endothelial lining) where TFPI is located. The method comprises contacting the biological structure (e.g., including, without limitation, a cell displaying TFPI on the cell surface) with a TFPI-binding peptide described herein, optionally conjugated to a moiety that adds additional functionality to the peptide. The moiety can be a dye (such as a fluorescence dye), a radionuclide or a radionuclide-containing complex, a protein (e.g., an enzyme, a toxin, or an antibody) or a cytotoxic agent. For example, the peptide is linked or conjugated to an effector moiety that facilitates peptide detection and/or purification and/or comprises therapeutic properties. In one aspect, the TFPI-binding peptide or peptide conjugate is administered to a mammal to target a TFPI-displaying cell within the mammal. Optionally, the method further comprises detecting binding of the TFPI-binding peptide to TFPI. The method is useful for therapy and diagnosis of disease where TFPI is a suitable diagnostic marker or TFPI-expressing cells are a target for a therapeutic approach.

Peptide-TFPI complexes are directly or indirectly detected. Detection moieties are widely used in the art to identify biological substances and include, for example, dye (e.g., fluorescent dye), radionuclides and radionuclide-containing complexes, and enzymes. In some aspects, peptide-TFPI binding is detected indirectly. In this regard, the peptide is optionally contacted with an interaction partner that binds the peptide of invention without significantly interfering with peptide-TFPI binding, and the interaction partner is detected. Exemplary interaction partners include, but are not limited to, antibodies, antigen-binding antibody fragments, anticalins and antibody mimetics, aptamers, streptavidin, avidin, neutravidin, and spiegelmers. Optionally, the interaction partner comprises a detection moiety to facilitate detection of an interaction partner-peptide complex. The TFPI-binding peptide is, in some embodiments, modified to facilitate binding of an interaction partner. For example, in one aspect, the TFPI-binding peptide is conjugated to biotin, which is bound by an interaction partner comprising streptavidin. An exemplary interaction partner comprises strepavidin fused to horseradish peroxidase, which is detected in, e.g., an ELISA-like assay. Alternatively, the TFPI-binding peptide is modified to include an antibody epitope, and binding of the corresponding antibody to the peptide-TFPI complex is detected. Methods of detecting, e.g., antibodies and fragments thereof, are well understood in the art.

Peptide-TFPI complexes and interaction partner-peptide complexes are identified using any of a number of methods, such as, but not limited to, biochemical assays (e.g., enzymatic assays), spectroscopy (e.g., detection based on optical density, fluorescence, FRET, BRET, TR-FRET, fluorescence polarization, electrochemoluminescence, or NMR), positron emission tomography (PET), and single Photon Emission Computed Tomography (SPECT). Detectable moieties that facilitate fluorescence detection of peptide-TFPI complexes or interaction partner-peptide complexes include, but are not limited to, fluorescein, Alexa Fluor® 350, Marina Blue™, Cascade Yellow™, Alexa Fluor® 405, Pacific Blue™, Pacific Orange™, Alexa Fluor® 430, Alexa Fluor® 488, Oregon Green® 488, Alexa Fluor® 500, Oregon Green® 514, Alexa Fluor® 514, Alexa Fluor® 532, Alexa Fluor® 555, Tetramethylrhodamine, Alexa Fluor® 546, Rhodamine B, Rhodamine Red™-X, Alexa Fluor® 568, Alexa Fluor® 594, Texas Red®, Texas Red®-X, Alexa Fluor® 610, Alexa Fluor® 633, Alexa Fluor® 635, Alexa Fluor® 647, Alexa Fluor® 660, Alexa Fluor® 680, Alexa Fluor® 700, Alexa Fluor® 750, B-Phycoerythrin, R-Phycoerythrin, Allophycocyanin, BODIPY®, Cy3, Cy5, TAMRA, and fluorescent proteins (GFP and derivatives thereof). An example of a TFPI-binding peptide comprising a fluorescent detection moiety is JBT2454 (FAM-Ttds-FQSKpNVHVDGYFERL-Aib-AKL-NH2 (SEQ ID NO: 4171)), which is labeled with 5,6-carboxyfluoresceine.

Radioactive labels also are used to detect biological materials (e.g., TFPI, TFPI-binding peptides, or TFPI-binding peptide-TFPI complexes), and, in some instances, are attached to peptides or interaction partners using a chelator, such as (but not limited to) EDTA (ethylene diamine tetraacetic acid), DTPA (diethylene triamine pentaacetic acid), CDTA (cyclohexyl 1,2-diamine tetra-acetic acid), EGTA (ethyleneglycol-O,O'-bis(2-aminoethyl)-N,N,N',N'-tetra-acetic), HBED (N,N-bis(hydroxybenzyl)-ethylenediamine-N,N'-diacetic acid), TTHA (triethylene tetramine hexa-acetic acid), DOTA (1,4,7,10-tetraazacyclododecane-N,N',N'',N'''-tetra-acetic acid), HEDTA (hydroxyethyldiamine triacetic acid), or TETA (1,4,8,11-tetra-azacyclotetradecane-N,N',N'',N'''-tetra-acetic acid). Examples of radioactive labels include $^{99m}$Tc, $^{203}$Pb, $^{66}$Ga, $^{67}$Ga, $^{68}$Ga, $^{72}$A5, $^{111}$In, $^{113m}$In, $^{114m}$In, $^{97}$Ru, $^{62}$Cu, $^{64}$Cu, $^{52}$Fe, $^{52m}$Mn, $^{51}$Cr, $^{186}$Re, $^{188}$Re, $^{77}$As, $^{90}$Y, $^{67}$Cu, $^{169}$Er, $^{117m}$Sn, $^{121}$Sn, $^{127}$Te, $^{142}$Pr, $^{143}$Pr, $^{198}$Au, $^{199}$Au, $^{149}$Tb, $^{161}$Tb, $^{109}$Pd, $^{165}$Dy, $^{149}$Pm, $^{151}$Pm, $^{153}$Sm, $^{157}$Gd, $^{166}$Ho, $^{172}$Tm, $^{169}$Yb, $^{175}$Yb, $^{177}$Lu, $^{105}$Rh, and $^{111}$Ag. Paramagnetic metals also are detectable moieties that are suitable for attachment to TFPI-binding peptides or interaction partners, optionally via chelator complex. Examples of paramagnetic metals include, for example, Cr, Mn, Fe, Co, Ni, Cu, Pr, Nd, Sm, Yb, Gd, Tb, Dy, Ho, and Er.

TFPI-binding peptides, themselves, are, in some aspects, modified to include one or more amino acids with detectable substituents or nuclides. In this regard, in one embodiment, the TFPI-binding peptide comprises at least one amino acid comprising a detectable isotope (e.g., $^{13}$C, $^{14}$C, $^{35}$S, $^{3}$H, $^{18}$O or $^{15}$N), and/or an amino acid that is halogenated with, e.g., $^{123}$I, $^{124}$I, $^{125}$I, $^{131}$I, $^{75}$Br, $^{76}$Br, $^{77}$Br or $^{82}$Br. Amino acids suitable for halogenation include, but are not limited to, tyrosine and tryptophan.

The invention also provides a method for diagnosing a subject suffering from a disease or disorder, or at risk of suffering from a disease or disorder, wherein the disease or disorder is associated with or caused by aberrant TFPI activity. The method comprises administering to the subject the TFPI-binding peptide and detecting the TFPI-peptide complex. In some instances, the peptide is conjugated to a detectable moiety, and the method comprises detecting the detectable moiety. Exemplary detectable moieties are described herein. In other instances, the method comprises administering to the subject a TFPI-binding peptide interaction partner that binds the TFPI-binding peptide, and detecting the interaction partner. If desired, the interaction partner comprises or is conjugated to a detectable moiety, and the detectable moiety is detected. The presence of the detectable moiety indicates the presence of TFPI, thereby allowing diagnosis of a disease or disorder associated with TFPI (e.g., a disease or disorder which (i) can be treated by inhibiting TFPI or (ii) comprises symptoms which can be ameliorated or prevented by inhibiting TFPI). If administration of the peptide to the subject is not desired, a biological sample is obtained from the subject, contacted with the TFPI-binding peptide as described herein, and TFPI-peptide complexes are detected.

The peptides of the invention bind TFPI and, therefore, are useful for purifying TFPI or recombinant TFPI from a biological sample (e.g., a biological fluid, such as serum), fermentation extract, tissue preparations, culture medium, and the like. The invention includes methods of using the TFPI-binding peptide in the commercial production of TFPI or in a method of characterizing TFPI molecules. For example, the invention includes a method of purifying TFPI. The method comprises contacting a sample containing TFPI with a peptide as defined herein under conditions appropriate to form a complex between TFPI and the peptide; removing the complex from the sample; and, optionally, dissociating the complex to release TFPI. Exemplary conditions appropriate to form a complex between TFPI and the peptide are disclosed in the Examples, and such conditions can be easily modified to dissociate the TFPI-peptide complex. In some embodiments, the peptide is immobilized to a support, e.g., a solid support, to facilitate recovery of TFPI. For example, in one embodiment, the peptide is immobilized to chromatography stationary phase (e.g., silica, affinity chromatography beads, or chromatography resins), a sample comprising TFPI is applied to the stationary phase such that TFPI-peptide complexes are formed, the remainder of the sample is removed from the stationary phase, and TFPI is eluted from the stationary phase. In this regard, the peptides of the invention are, in one aspect, suitable for use in affinity chromatography techniques.

A method of enhancing thrombin formation in a clotting factor-deficient subject also is provided. The method comprises administering to the subject a peptide provided herein under conditions effective to inhibit TFPI. In this regard, the TFPI-binding peptide is administered in an amount and under conditions effective to enhance thrombin formation in the subject. By "clotting factor-deficient" is meant that the subject suffers from a deficiency in one or more blood factors required for thrombin formation, such as FVIII, FIX, or FXI. Indeed, in one embodiment, the subject is deficient in FVIII. Alternatively or in addition, the subject is deficient in Factor IX. Clotting factor deficiencies are identified by examining the amount of factor in a clinical sample. Practitioners classify hemophilia according to the magnitude of clotting factor deficiency. Subjects suffering from mild hemophilia have approximately 5% to 30% of the normal amount (1 U/ml) of Factor VIII or Factor IX. Moderate hemophilia is characterized by approximately 1% to 5% of normal Factor VIII, Factor IX, or Factor XI levels, while subjects suffering from severe hemophilia have less than 1% of the normal amount of Factor VIII, Factor IX, or Factor XI. Deficiencies can be identified indirectly by activated partial thromboplastin time (APTT) testing. APTT testing measures the length of time required for a blood clot to form, which is longer for patients with Factor VIII Deficiency (hemophilia A), Factor IX Deficiency (hemophilia B), and Factor XI Deficiency (hemophilia C) compared to patients with normal clotting factor levels. Almost 100% of patients with severe and moderate Factor VIII deficiency can be diagnosed with an APTT. The invention further includes enhancing thrombin formation in a subject that does not suffer from a clotting factor deficiency. The method comprises administering to a subject (e.g., a subject comprising normal, physiological levels of clotting factor) a peptide provided herein under conditions effective to enhance thrombin formation.

In one aspect, the TFPI-binding peptide is used for increasing blood clot formation in a subject. The method of increasing blood clot formation comprises administering to the subject a peptide described herein in an amount and under conditions effective to increase blood clot formation. It will be appreciated that the method need not completely restore the coagulation cascade to achieve a beneficial (e.g., therapeutic) effect. Any enhancement or increase in thrombin or blood clot formation that reduces the onset or severity of symptoms associated with clotting factor deficiencies is contemplated. Methods of determining the efficacy of the method in promoting thrombin formation and blood clotting are known in the art and described herein.

The invention further includes a method of treating a blood coagulation disorder in a subject, the method comprising administering to the subject one or more TFPI-binding peptides (or peptide complex(es)), such as any one or more of the peptides described herein, in an amount and under conditions effective to treat the blood coagulation disorder in the subject. In one aspect, the peptide is a recombinant or synthetic peptide that inhibits TFPI activity. "Coagulation disorders" include bleeding disorders caused by deficient blood coagulation factor activity and deficient platelet activity. Blood coagulation factors include, but are not limited to, Factor V (FV), FVII, FVIII, FIX, FX, FXI, FXIII, FII (responsible for hypoprothrombinemia), and von Willebrand's factor. Factor deficiencies are caused by, for instance, a shortened in vivo-half life of the factor, altered binding properties of the factor, genetic defects of the factor, and a reduced plasma concentration of the factor. Coagulation disorders can be congenital or acquired. Potential genetic defects include deletions, additions and/or substitution within a nucleotide sequence encoding a clotting factor whose absence, presence, and/or substitution, respectively, has a negative impact on the clotting factor's activity. Coagulation disorders also stem from development of inhibitors or autoimmunity (e.g., antibodies) against clotting factors. In one example, the coagulation disorder is hemophilia A. Alternatively, the coagulation disorder is hemophilia B or hemophilia C.

Platelet disorders are caused by deficient platelet function or abnormally low platelet number in circulation. Low platelet count may be due to, for instance, underproduction, platelet sequestration, or uncontrolled patent destruction. Thrombocytopenia (platelet deficiencies) may be present for various reasons, including chemotherapy and other drug therapy, radiation therapy, surgery, accidental blood loss, and other disease conditions. Exemplary disease conditions that involve thrombocytopenia are: aplastic anemia; idiopathic or immune thrombocytopenia (ITP), including idiopathic thrombocytopenic purpura associated with breast cancer; HIV-associated ITP and HIV-related thrombotic thrombocytopenic purpura; metastatic tumors which result in thrombocytopenia; systemic lupus erythematosus, including neonatal lupus syndrome splenomegaly; Fanconi's syndrome; vitamin B12 deficiency; folic acid deficiency; May-Hegglin anomaly; Wiskott-Aldrich syndrome; chronic liver disease; myelodysplastic syndrome associated with thrombocytopenia; paroxysmal nocturnal hemoglobinuria; acute profound thrombocytopenia following C7E3 Fab (Abciximab) therapy; alloimmune thrombocytopenia, including maternal alloimmune thrombocytopenia; thrombocytopenia associated with antiphospholipid antibodies and thrombosis; autoimmune thrombocytopenia; drug-induced immune thrombocytopenia, including carboplatin-induced thrombocytopenia and heparin-induced thrombocytopenia; fetal thrombocytopenia; gestational thrombocytopenia; Hughes' syndrome; lupoid thrombocytopenia; accidental and/or massive blood loss; myeloproliferative disorders; thrombocytopenia in patients with malignancies; thrombotic thrombocytopenia purpura, including thrombotic microangiopathy manifesting as thrombotic thrombocytopenic purpura/hemolytic uremic syndrome in cancer patients; post-transfusion purpura (PTP); autoimmune hemolytic anemia; occult jejunal diverticulum perforation; pure red cell aplasia; autoimmune thrombocytopenia; nephropathia epidemica; rifampicin-associated acute renal failure; Paris-Trousseau thrombocytopenia; neonatal alloimmune thrombocytopenia; paroxysmal nocturnal hemoglobinuria; hematologic changes in stomach cancer; hemolytic uremic syndromes (e.g., uremic conditions in childhood); and hematologic manifestations related to viral infection including hepatitis A virus and CMV-associated thrombocytopenia. Platelet disorders also include, but are not limited to, Von Willebrand Disease, paraneoplastic platelet dysfunction, Glanzman's thrombasthenia, and Bernard-Soulier disease. Additional bleeding disorders amenable to treatment with a TFPI-binding peptide (e.g., TFPI-inhibitory peptide) include, but are not limited to, hemorrhagic conditions induced by trauma; a deficiency in one or more contact factors, such as FXI, FXII, prekallikrein, and high molecular weight kininogen (HMWK); vitamin K deficiency; a fibrinogen disorder, including afibrinogenemia, hypofibrinogenemia, and dysfibrinogenemia; and alpha2-antiplasmin deficiency. In one embodiment, the TFPI-binding peptide (e.g., TFPI-inhibitory peptide) is used to treat excessive bleeding, such as excessive bleeding caused by surgery, trauma, intracerebral hemorrhage, liver disease, renal disease, thrombocytopenia, platelet dysfunction, hematomas, internal hemorrhage, hemarthroses, hypothermia, menstruation, pregnancy, and Dengue hemorrhagic fever. All of the above are considered "blood coagulation disorders" in the context of the disclosure.

In one aspect, the TFPI-binding peptide (e.g., TFPI-inhibitory peptide) of the invention is used to reverse the effects (in whole or in part) of one or more anticoagulants in a subject. Numerous anticoagulants are known in the art and include, for instance, heparin; coumarin derivatives, such as warfarin or dicumarol; TFPI; AT III; lupus anticoagulant; nematode anticoagulant peptide (NAPc2); FVIIa inhibitors; active-site blocked FVIIa (FVIIai); active-site blocked FIXa (FIXai); FIXa inhibitors; FXa inhibitors, including fondaparinux, idraparinux, DX-9065a, and razaxaban (DPC906); active-site blocked FXa (FXai); inhibitors of FVa or FVIIIa, including activated protein C (APC) and soluble thrombomodulin; thrombin inhibitors, including hirudin, bivalirudin, argatroban, and ximelagatran; and antibodies or antibody fragments that bind a clotting factor (e.g., FV, FVII, FVIII, FIX, FX, FXIII, FII, FXI, FXII, von Willebrand factor, prekallikrein, or high molecular weight kininogen (HMWK)).

As used herein, "treating" and "treatment" refers to any reduction in the severity and/or onset of symptoms associated with a blood coagulation disorder. Accordingly, "treating" and "treatment" includes therapeutic and prophylactic measures. One of ordinary skill in the art will appreciate that any degree of protection from, or amelioration of, a blood coagulation disorder or symptom associated therewith is beneficial to a subject, such as a human patient. The quality of life of a patient is improved by reducing to any degree the severity of symptoms in a subject and/or delaying the appearance of symptoms. Accordingly, the method in one aspect is performed as soon as possible after it has been determined that a subject is at risk for developing a blood coagulation disorder (e.g., a deficiency in a clotting factor (e.g., FVIII, FIX, or FXI) is detected) or as soon as possible after a blood coagulation disorder (e.g., hemophilia A, hemophilia B, or hemophilia C) is detected. In an additional aspect, the peptide is administered to protect, in whole or in part, against excessive blood loss during injury or surgery.

In view of the above, the invention provides a peptide (or peptide complex) for use in a method for the treatment of a subject, such as a method for the treatment of a disease where the inhibition of TFPI is beneficial. In one aspect, the disease or disorder is a blood coagulation disorder. The subject is suffering from a disease or disorder or is at risk from suffering from a disease or disorder (or adverse biological event, such as excessive blood loss). The method comprises administering to the subject the peptide (or peptide complex) of the invention in an amount and under conditions effective to treat or prevent, in whole or in part, the disease or disorder. The invention further provides a peptide (or peptide complex) for use in the manufacture of a medicament. For example, the peptide (or peptide complex) can be used in the manufacture of a medicament for the treatment of a blood coagulation disorder, as described in detail herein.

In some embodiments, it is advantageous to administer to a subject a nucleic acid comprising a nucleic acid sequence encoding a peptide complex or peptide (e.g., TFPI-binding peptide, TFPI-inhibitory peptide) of the invention. Such a nucleic acid, in one aspect, is provided instead of, or in addition to, a peptide complex or peptide (e.g., TFPI-binding, TFPI-inhibitory peptide). Expression vectors, nucleic acid regulatory sequences, administration methods, and the like, are further described herein and in U.S. Patent Publication No. 20030045498.

A particular administration regimen for a particular subject will depend, in part, upon the TFPI-inhibitory peptide of the invention used, the amount of TFPI-binding peptide (e.g., TFPI-inhibitory peptide) administered, the route of administration, the particular ailment being treated, considerations relevant to the recipient, and the cause and extent of any side effects. The amount of peptide administered to a subject (e.g., a mammal, such as a human) and the conditions of administration (e.g., timing of administration, route of administration, dosage regimen) are sufficient to affect the desired biological response over a reasonable time frame. Dosage typically depends upon a variety of factors, including the particular TFPI-binding peptide (e.g., TFPI-inhibitory peptide) employed, the age and body weight of the subject, as well as the existence and severity of any disease or disorder in the subject. The size of the dose also will be determined by the route, timing, and frequency of administration. Accordingly, the clinician may titer the dosage and modify the route of administration to obtain the optimal therapeutic effect, and conventional range-finding techniques are known to those of ordinary skill in the art. Purely by way of illustration, in one aspect, the method comprises administering, e.g., from about 0.1 µg/kg to about 100 mg/kg or more, depending on the factors mentioned above. In other embodiments, the dosage may range from 1 µg/kg up to about 75 mg/kg; or 5 µg/kg up to about 50 mg/kg; or 10 µg/kg up to about 20 mg/kg. In certain embodiments, the dose comprises about 0.5 mg/kg to about 20 mg/kg (e.g., about 1 mg/kg, 1.5 mg/kg, 2 mg/kg, 2.3 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 8 mg/kg, 9 mg/kg, or 10 mg/kg) of peptide. Given the chronic nature of many blood coagulation disorders, it is envisioned that a subject will receive the TFPI-binding peptide (e.g., TFPI-inhibitory peptide) over a treatment course lasting weeks, months, or years, and may require one or more doses daily or weekly. In other embodiments, the TFPI-binding peptide (e.g., TFPI-inhibitory peptide) is administered to treat an acute condition (e.g., bleeding caused by surgery or trauma, or factor inhibitor/autoimmune episodes in subjects receiving coagulation replacement therapy) for a relatively short treatment period, e.g., one to 14 days.

Suitable methods of administering a physiologically-acceptable composition, such as a pharmaceutical composition comprising a peptide described herein, are well known in the art. Although more than one route can be used to administer a peptide, a particular route can provide a more immediate and more effective reaction than another route. Depending on the circumstances, a pharmaceutical composition is applied or instilled into body cavities, absorbed through the skin or mucous membranes, ingested, inhaled, and/or introduced into circulation. In one aspect, a composition comprising a TFPI-binding peptide (e.g., TFPI-inhibitory peptide) is administered intravenously, intraarterially, or intraperitoneally to introduce the peptide of the invention into circulation. Non-intravenous administration also is appropriate, particularly with respect to low molecular weight therapeutics. In certain circumstances, it is desirable to deliver a pharmaceutical composition comprising the TFPI-binding peptide (e.g., TFPI-inhibitory peptide) orally, topically, sublingually, vaginally, rectally, pulmonary; through injection by intracerebral (intra-parenchymal), intracerebroventricular, intramuscular, intra-ocular, intraportal, intralesional, intramedullary, intrathecal, intraventricular, transdermal, subcutaneous, intranasal, urethral, or enteral means; by sustained release systems; or by implantation devices. If desired, the TFPI-binding peptide (e.g., TFPI-inhibitory peptide) is administered regionally via intraarterial or intravenous administration feeding a region of interest, e.g., via the femoral artery for delivery to the leg. In one embodiment, the peptide is incorporated into a microparticle as described in, for example, U.S. Pat. Nos. 5,439,686 and 5,498,421, and U.S. Patent Publications 2003/0059474, 2003/0064033, 2004/0043077, 2005/0048127, 2005/0170005, 2005/0142205, 2005/142201, 2005/0233945, 2005/0147689. 2005/0142206, 2006/0024379, 2006/0260777, 2007/0207210, 2007/0092452, 2007/0281031, and 2008/0026068. Alternatively, the composition is administered via implantation of a membrane, sponge, or another appropriate material on to which the desired molecule has been absorbed or encapsulated. Where an implantation device is used, the device in one aspect is implanted into any suitable tissue, and delivery of the desired molecule is in various aspects via diffusion, timed-release bolus, or continuous administration. In other aspects, the TFPI-inhibitory peptide is administered directly to exposed tissue during surgical procedures or treatment of injury, or is administered via transfusion of blood procedures. Therapeutic delivery approaches are well known to the skilled artisan, some of which are further described, for example, in U.S. Pat. No. 5,399,363.

To facilitate administration, the TFPI-binding peptide (e.g., TFPI-inhibitory peptide) or peptide complex in one embodiment is formulated into a physiologically-acceptable composition comprising a carrier (i.e., vehicle, adjuvant, buffer, or diluent). The particular carrier employed is limited only by chemico-physical considerations, such as solubility and lack of reactivity with the peptide, and by the route of administration. Physiologically-acceptable carriers are well known in the art. Illustrative pharmaceutical forms suitable for injectable use include without limitation sterile aqueous solutions or dispersions and sterile powders for the extemporaneous preparation of sterile injectable solutions or dispersions (for example, see U.S. Pat. No. 5,466,468). Injectable formulations are further described in, e.g., Pharmaceutics and Pharmacy Practice, J. B. Lippincott Co., Philadelphia. Pa., Banker and Chalmers. eds., pages 238-250 (1982), and ASHP Handbook on Injectable Drugs, Toissel, $4^{th}$ ed., pages 622-630 (1986)). A pharmaceutical composition comprising a peptide provided herein is optionally placed within containers, along with packaging material that provides instructions regarding the use of such pharmaceutical compositions. Generally, such instructions include a tangible expression describing the reagent concentration, as well as, in certain embodiments, relative amounts of excipient ingredients or diluents that may be necessary to reconstitute the pharmaceutical composition.

When appropriate, the TFPI-binding peptide (e.g., TFPI-inhibitory peptide) or peptide complex of the invention is administered in combination with other substances and/or other therapeutic modalities to achieve an additional or augmented biological effect. Co-treatments include, but are not limited to, plasma-derived or recombinant coagulation factors, hemophilia prophylaxis treatments, immunosuppressants, plasma factor-inhibiting antibody antagonists (i.e., anti-inhibitors), antifibrinolytics, antibiotics, hormone therapy, anti-inflammatory agents (e.g., Non-Steroidal Anti-Inflammatory Drugs (NSAIDs) or steroidal anti-inflammatory substances), procoagulants, and pain relievers. In one aspect, the method is an adjunct therapy to traditional replacement factor treatment regimens involving administration of, e.g., FXIII, FXII, FXI (e.g., HEMOLEVEN® (Laboratoire francais du Fractionnement et des Biotechnologies, Les Ulis, France) and FXI concentrate (BioProducts Laboratory, Elstree, Hertfordshire, UK)), FX, FIX (e.g., BENEFIX® Coagulation Factor IX (Wyeth, Madison, N.J.); ALPHANINE® SD (Grifols, Los Angeles, Calif.); MONONINE® (CSL Behring, King of Prussia, Pa.); BEBULIN-VH™ (Baxter, Deerfield, Ill.); PROFILNINE® SD (Grifols, Los Angeles, Calif.); or PROPLEX T™ (Baxter, Deerfield, Ill.)), FVIII (e.g., ADVATE™ (Baxter, Deerfield, Ill.); HELIXATE® FS(CSL Behring, King of Prussia, Pa.); REFACTO® (Wyeth, Madison, N.J.), XYNTHA™ (Wyeth, Madison, N.J.), KOGENATE® and KOGENATE® FS (Bayer, Pittsburgh, Pa.); ALPHANATE® (Grifols, Los Angeles, Calif.); HEMOPHIL M™ (Baxter, Deerfield, Ill.); KOATE®-DVI (Talecris Biotherapeutics-USA, Research Triangle Park, N.C.); or MONARC-M™ (Baxter, Deerfield, Ill.)), FVIIa (e.g., NOVOSEVEN® FVIIa (Novo Nordisk, Princeton, N.J.) and FVII concentrate (Baxter Bioscience, Vienna, Austria, or BioProducts Laboratory, Elstree, Hertfordshire, UK)), FV, FVa, FII, and/or FIII, to a subject. In some instances, the subject also receives FEIBA VH Immuno™ (Baxter Bio-Science, Vienna, Austria), which is a freeze-dried sterile human plasma fraction with Factor VIII inhibitor bypassing activity. FEIBA VH Immuno™ contains approximately equal units of Factor VIII inhibitor bypassing activity and Prothrombin Complex Factors (Factors II, VII, IX, and X and protein C). Other exemplary co-treatments include, but are not limited to, prekallikrein, high molecular weight kininogen (HMWK), Von Willebrand's factor, Tissue Factor, and thrombin. Alternatively or in addition, the TFPI-binding peptide (e.g., TFPI-inhibitory peptide) is co-formulated with one or more different TFPI-binding peptides (e.g., TFPI-inhibitory peptides). In one aspect, administration of the TFPI-binding peptide allows a reduction in the dose of co-therapeutic required to achieve a desired biological response.

The invention thus includes administering to a subject a TFPI-binding peptide (e.g., TFPI-inhibitory peptide) of the invention (or multiple TFPI-binding peptides, or a peptide complex), in combination with one or more additionally suitable substances(s), each being administered according to a regimen suitable for that medicament. Administration strategies include concurrent administration (i.e., substantially simultaneous administration) and non-concurrent administration (i.e., administration at different times, in any order, whether overlapping or not) of the TFPI-binding peptide (e.g., TFPI-inhibitory peptide) (or peptide complex) and one or more additionally suitable agents(s). It will be appreciated that different components are optionally administered in the same or in separate compositions, and by the same or different routes of administration.

In some embodiments, the peptide of the invention is conjugated to a moiety, e.g., a therapeutic or diagnostic moiety, such as the detection moieties and co-treatments described above. Alternatively or in addition, the peptide is administered in combination with an interaction partner (e.g., an antibody, antibody fragment, anticalin, aptamer, or spiegelmer) that (a) binds the peptide and (b) is therapeutically active and/or is linked to a moiety that provides additional functionality to the interaction partner (e.g., a therapeutic, diagnostic, or detection agent). Suitable moieties include, but are not limited to, photosensitizers, dyes, radionuclides, radionuclide-containing complexes, enzymes, toxins, antibodies, antibody fragments, and cytotoxic agents, and, in some instances, the moiety possesses therapeutic activity (i.e., achieves an advantageous or desired biological effect). The peptide conjugates or peptide-interaction partner pair is suitable for use in any of the methods described herein, such as methods of treating a subject suffering from a disease or disorder or at risk of suffering from a disease or disorder.

The invention further provides a method for inhibiting degradation of TFPI by a serine protease. Protease degradation can complicate handling of TFPI in research settings. Additionally, although TFPI inhibition is desired to improve various medical conditions (e.g., hemophilia), TFPI may be desired in other clinical embodiments to, for example, reduce coagulation. By "inhibiting" is meant protection, in whole in part, from degradation or cleavage by a protease. Serine proteases are well characterized and include, e.g., elastase, thrombin, plasmin, FXa, or chymase. The method comprises contacting TFPI with a peptide comprising the structure of formula (XIV):

X7001-X7002-X7003-X7004-X7005-X7006-(XIV)
(SEQ ID NO: 3154), wherein X7001 is either present or absent, whereby in case X7001 is present it is an amino acid selected from the group consisting of A, C, C(NEM), D, E, F, G, H, I, K, L, P, R, S, T, V and W;

wherein X7002 is either present or absent, whereby in case X7002 is present it is an amino acid selected from the group consisting of A, C, C(NEM), D, E, F, G, H, I, K, L, M, P, Q, R, S, T, V, W and Y;

wherein X7003 is an amino acid selected from the group consisting of A, F, I, K, L, R, S, T, V, W and Y;

wherein X7004 is an amino acid selected from the group consisting of A, D, E, F, G, I, K, L, R, S, T, V and W;

wherein X7005 is R or W;

wherein X7006 is an amino acid selected from the group consisting of F, H, I, K, L, R, V and W;

wherein X7007 is an amino acid selected from the group consisting of Orn, homoK, C, Hcy, Dap and K, preferably selected from the group consisting of C and Hcy;

wherein X7008 is an amino acid selected from the group consisting of A, G, R, S and T;

wherein X7009 is an amino acid selected from the group consisting of a, A, I, K, L, M, m, Moo, Nle, p, R, Sem and V;

wherein X7010 is an amino acid selected from the group consisting of A, G, I, K, L, P, R, S, T and V;

wherein X7011 is an amino acid selected from the group consisting of D, E, G, S and T;

wherein X7012 is an amino acid selected from the group consisting of A, a, D, d, E, e, F, f, G, I, K, k, L, l, M, m, Moo, Nle, nle, P, p, R, r, S, s, Sem, T, t, V, v, W and w;

wherein X7013 is an amino acid selected from the group consisting of A, C, C(NEM), Con, Con(Meox), D, d, E, e, Eag, F, G, I, K, L, N, R, S, s, T, V and W;

wherein X7014 is an amino acid selected from the group consisting of A, D, E, F, G, I, K, L, M, R, S, T, V and W;

wherein X7015 is an amino acid selected from the group consisting of A, D, E, F, G, I, K, L, M, Nle, R, S, T, V and W;

wherein X7016 is an amino acid selected from the group consisting of A, D, E, F, I, K, L, M, Moo, Nle, R, S, Sem, T, V, W and Y;

wherein X7017 is an amino acid selected from the group consisting of A, D, E, F, G, I, K, L, R, S, T, V, W and Y;

wherein X7018 is an amino acid selected from the group consisting of C and D, preferably C;

wherein X7019 is an amino acid selected from the group consisting of A, F, I, L, S, T, V and W;

wherein X7020 is an amino acid selected from the group consisting of F and W;

wherein X7021 is an amino acid selected from the group consisting of I, L and V;

wherein X7022 is an amino acid selected from the group consisting of A, D, E, F, G, I, K, L, P, R, S, T, V and W;

wherein X7023 is either present or absent, whereby in case X7023 is present it is an amino acid selected from the group consisting of A, C, C(NEM), Con, Con(Meox), D, E, Eag, F, G, I, K, L, R, S, T, V, W and Y; and wherein the peptide comprises as a cyclic structure generated by a linkage between X7007 and X7018, whereby degradation of TFPI by the serine protease is inhibited. Optionally, X7001 is an amino acid selected from the group consisting of A, D, F, G, H, K, L and S; X7002 is an amino acid selected from the group consisting of H, F, M and R; X7003 is an amino acid selected from the group consisting of F and Y; X7004 is K; X7005 is W; X7006 is an amino acid selected from the group consisting of F and H; X7007 is C; X7008 is an amino acid selected from the group consisting of A, G and S; X7009 is an amino acid selected from the group consisting of M, Sem and V; X7010 is an amino acid selected from the group consisting of K, P and R; X7011 is D; wherein X7012 is an amino acid selected from the group consisting of F, L, l, M and Sem; wherein X7013 is an amino acid selected from the group consisting of D, G, K and S; wherein X7014 is G; wherein X7015 is an amino acid selected from the group consisting of I and T; wherein X7016 is an amino acid selected from the group consisting of D, F, M, Sem and Y; wherein X7017 is an amino acid selected from the group consisting of S and T; wherein X7018 is C; wherein X7019 is an amino acid selected from the group consisting of A and V; wherein X7020 is W; wherein X7021 is V; wherein X7022 is an amino acid selected from the group consisting of F, L, K, R, P and W; wherein X7023 is either present or absent, whereby in case X7023 is present it is an amino acid sequence selected from the group consisting of A, D, F, M, S and Y; and wherein the peptide comprises as a cyclic structure generated by a linkage between X7007 and X7018. The "contacting" may be performed in vitro or in vivo. The dosage and route of administration considerations described herein are applicable to the method of inhibiting proteolytic degradation.

The peptide is optionally part of a peptide complex that further comprises a peptide comprising the structure of formula (XIII):

X6001-X6002-X6003-X6004-X6005-X6006-X6007-X6008-X6009-X6010-X6011-X6012-X6013-X6014-X6015-X6016-X6017-X6018-X6019-X6020 (XIII) (SEQ ID NO: 3153);

wherein X6001 is an amino acid selected from the group consisting of F, L, M, Y, 1Ni, Thi, Bta, Dopa, Bhf, C, D, G, H, I, K, N, Nmf, Q, R, T, V, and W;

wherein X6002 is an amino acid selected from the group consisting of Q, G, and K;

wherein X6003 is an amino acid selected from the group consisting of C, D, E, M, Q, R, S, T, Ede(O), Cmc, A, Aib, Bhs, F, G, H, I, K, L, N, P, V, W and Y;

wherein X6004 is an amino acid selected from the group consisting of Aib, E, G, I, K, L, M, P, R, W, Y, A, Bhk, C, D, F, H, k, N, Nmk, Q, S, T and V;

wherein X6005 is an amino acid selected from the group consisting of a, A, Aib, C, D, d, E, G, H, K, k, M, N, Nmg, p, Q, R, NpropylG, aze, pip, tic, oic, hyp, nma, Ncg, Abg, Apg, thz, dtc, Bal, F, L, S, T, V, W and Y;

wherein X6006 is an amino acid selected from the group consisting of A, C, C(NEM), D, E, G, H, K, M, N, Q, R, S, V, Cit, C(Acm), Nle, I, Ede(O), Cmc, Ed, Eea, Eec, Eef, Nif, Eew, Aib, Btq, F, I, L, T, W and Y;

wherein X6007 is an amino acid selected from the group consisting of I, V, T, Chg, Phg, Tle, A, F, G, I, K, L, Nmv, P, Q, S, W and Y;

wherein X6008 is an amino acid selected from the group consisting of F, H, 1Ni, 2Ni, Pmy, Y, and W;

wherein X6009 is an amino acid selected from the group consisting of Aib, V, Chg, Phg, Abu, Cpg, Tle, L-2-amino-4,4,4-trifluorobutyric acid, A, f, I, K, S, T and V;

wherein X6010 is an amino acid selected from the group consisting of A, C, D, d, E, F, H, K, M, N, P, Q, R, S, T, V, W, Y, Nmd, C(NEM), Aib, G, I, L and Nmf;

wherein X6011 is an amino acid selected from the group consisting of A, a, G, p, Sar, c, hcy, Aib, C, K, G and Nmg;

wherein X6012 is an amino acid selected from the group consisting of Y, Tym, Pty, Dopa and Pmy;

wherein X6013 is an amino acid selected from the group consisting of Aib, C, F, 1Ni, Thi, Bta, A, E, G, H, K, L, M, Q, R, W and Y;

wherein X6014 is an amino acid selected from the group consisting of A, Aib, C, C(NEM), D, E, K, L, M, N, Q, R, T, V, Hcy, Bhe, F, G, H, I, P, S, W and Y;

wherein X6015 is an amino acid selected from the group consisting of R, (omega-methyl)-R, D, E and K;

wherein X6016 is an amino acid selected from the group consisting of L, Hcy, Hle and Aml;

wherein X6017 is an amino acid selected from the group consisting of A, a, Aib, C, c, Cha, Dab, Eag, Eew, H, Har, Hci, Hle, I, K, L, M, Nle, Nva, Opa, Orn, R, S, Deg, Ebc, Eca, Egz, Aic, Apc, Egt, (omega-methyl)-R, Bhr, Cit, D, Dap, E, F, G, N, Q, T, V, W and Y;

wherein X6018 is an amino acid selected from the group consisting of A, Aib, Hcy, hcy, C, c, L, Nle, M, N, R, Bal, D, E, F, G, H, I, K, Q, S, T, V, W and Y;

wherein X6019 is an amino acid selected from the group consisting of K, R, Har, Bhk and V; and wherein X6020 is an amino acid selected from the group consisting of K, L, Hcy, Aml, Aib, Bhl, C, F, G, H, I, Nml, Q, R, S, T, V, W and Y.

The invention further provides a method for identifying a TFPI-binding compound, such as a TFPI-binding peptide. In one aspect, the method comprises (a) contacting a peptide comprising TFPI Kunitz domain 1 (KD1) with a TFPI-binding peptide described herein and a test compound under conditions that allow formation of KD1-TFPI-binding peptide complexes. The method further comprises (b) measuring KD1-TFPI-binding peptide complexes formed in step (a), and (c) comparing the number of KD1-TFPI-binding peptide complexes formed in the presence of the test compound with the number of KD1-TFPI-binding peptide complexes formed in the absence of the test compound. A reduction in the number of KD1-TFPI-binding peptide complexes formed in the presence of the test compound compared to the number of KD1-TFPI-binding peptide complexes formed in the absence of the test compound indicates that the test compound is a TFPI-binding compound. In one aspect, the method further comprises forming KD1-TFPI-binding complexes in the absence of the test compound for comparison in step (c), although this is not required inasmuch as the information may be obtained separately (e.g., from previously prepared reference standards).

KD1, the TFPI-binding peptide, and the test compound are combined simultaneously or sequentially, optionally with washing steps before and/or after addition of the TFPI-binding peptide and/or the test compound. In one embodiment, the peptide comprising KD1 is contacted with a TFPI-binding peptide described herein under conditions that allow formation of KD1-TFPI-binding peptide complexes, unbound TFPI-binding peptide is removed, and the remaining KD-peptide complexes are contacted with a test compound. Displacement of the TFPI-binding peptide from the TFPI-peptide complexes is detected, and indicates that the test compound is a TFPI-binding compound. Displacement is detected by, for example, measuring the number of KD1-TFPI-binding peptide complexes before and after exposure to the test compound.

KD1-TFPI-binding peptide complexes are detected and/or measured (quantified) using any suitable detection means, including detection means known in the art for detecting peptides in a sample. For example, in one embodiment of the invention, the TFPI-binding peptide comprises a label that generates a signal. Exemplary labels are described herein and include, e.g., radionuclides, fluorescent dyes, isotopes, enzyme substrates, and enzymes. The method comprises measuring signal generated by KD1-TFPI-binding peptide complexes and comparing signal generated by KD1-TFPI-binding peptide complexes formed in the presence of the test compound with signal generated by KD1-TFPI-binding peptide complexes formed in the absence of the test compound. A reduction in signal from a sample comprising KD1-TFPI-binding peptide complexes exposed to test compound (compared to signal generated by a similar sample of KD1-TFPI-binding peptide complexes not exposed to the test compound) indicates that complex formation has been inhibited or disrupted, and that the test compound is a TFPI-binding compound.

The invention also provides a method of identifying a TFPI-binding compound that interferes with TFPI-FXa interactions. The method is predicated, at least in part, on the surprising discovery that TFPI KD1 binds to an exosite of FXa and contributes to TFPI's inhibition of FXa activity. In one aspect, the method comprises contacting a peptide consisting essentially of KD1 (i.e., a peptide comprising KD1 in the absence of KD2) with FXa in the presence of a test compound under conditions that allow binding of KD1 to FXa. The method further comprises comparing KD1-FXa binding in the presence of the test compound with KD1-FXa binding in the absence of the test compound. A decrease in KD1-FXa binding in the presence of the test compound compared to KD1-FXa binding in the absence of the test compound indicates that the test compound is a TFPI-binding compound. KD1-FXa binding can be detected and/or quantitated using any method, such as the methods described herein. For example, KD1 or FXa is labeled, and the signal generated by KD1-FXa complexes exposed to the test compound is compared to the signal generated by KD1-FXa complexes not exposed to the test compound.

The methods of the invention to identify TFPI-binding compounds are particularly amenable to the various high throughput screening techniques known in the art. Any "test compound" (e.g., small molecule, peptide, protein (such as an antibody or fragment thereof), peptidomimetic, or polynucleotide (DNA or RNA)) is suitable for screening using the methods described herein. If desired, a collection, population, or library of test compounds is screened for TFPI binding (and, optionally, anti-TFPI activity) using the methods described herein. There are a number of different libraries used for the identification of TFPI inhibitors, including, but not limited to, chemical libraries, natural product libraries, and combinatorial libraries comprising peptides and/or organic molecules. A chemical library, in some aspects, consists of structural analogs of known compounds or compounds that are identified as "hits" or "leads" via other screening methods. Natural product libraries are collections of substances isolated from or produced by microorganisms, animals, plants, or marine organisms. Combinatorial libraries are composed of large numbers of peptides or organic compounds, typically as a mixture. The methods described herein also are useful for screening a display or nucleic acid library, such as a yeast display library, a bacterial display library, a phage display library, a ribosome display library, an mRNA display library, a RNA library, or a DNA library. One method of screening a display library is exemplified in Example 1. High throughput screening methods embraced by the invention include automated procedures allowing screening of tens to hundreds of thousands of test compounds.

In another aspect, the inventive method for identifying a TFPI-binding compound comprises contacting a peptide comprising (or consisting of) KD1 with a test compound, and detecting binding of the test compound to a TFPI binding site defined by KD1 amino acid residues corresponding to human TFPI residues Phe28, Lys29, Ala30, Asp32, Ile46, Phe47, and Ile55, such as a binding site defined by human TFPI residues Ala27, Phe28, Lys29, Ala30, Asp31, Asp32, Lys36, Ile38, Ile46, Phe47, and Ile55. In one embodiment, the binding site is defined by amino acid residues corresponding to human TFPI residues Ala27, Phe28, Lys29, Ala30, Asp31, Asp32, Lys36, Ala37, Ile38, Phe44, Ile46, Phe47, and Ile55. The binding site corresponds to the TFPI binding site of JBT1857, a TFPI-binding peptide that inhibits TFPI activity in a number of functional assays. JBT1857 is an example of a peptide of the JBT0047 class of peptides represented herein as, e.g., formulas (I)-(IV) and (XI), and examples of which are set forth in FIGS. 32, 62, and 65.

Additionally, the invention provides a method for identifying a TFPI-binding compound comprises contacting a peptide comprising KD1-KD2 (including the region of the TFPI polypeptide linking KD1 and KD2) with a test compound, and detecting binding of the test compound to a TFPI binding site defined by KD1-KD2 amino acid residues corresponding to human TFPI residues R41, Y53, C59, E60, Q63, R65, E67, E71, K74, M75, N80, N82, R83, I84, I85, T87, F96, C106, C130, L131, N133, M134, N136, F137, E142, N145, and I146. The binding site corresponds to the TFPI binding site of JBT1837, a TFPI-binding peptide that inhibits TFPI activity in a number of functional assays. JBT1837 is an example of a peptide of the JBT0120 class of peptides represented herein as, e.g., formulas (V)-(VII), and examples of which are set forth in FIG. 34.

The TFPI binding site amino acid residues described herein are in reference to the human TFPI amino acid sequence, and the numbering refers to the position of the recited amino acid in relation to the N-terminus of human TFPI. Merely for the purpose of illustrating the position of the TFPI binding site, the amino acid sequence of a fragment of human TFPI comprising KD1 is provided as SEQ ID NO: 4234 (DSEEDEEHTIITDTELPPLKLMHSFCAF-KADDGPCKAIMKRFFFNIFTRQCEEFIGG CEGNQNR-FESLEECKKMCTRDNA (amino acids 26-75 encoding KD1 are indicated in bold)). Corresponding amino acids of other TFPI polypeptides (such as TFPI polypeptides from different organisms, or TFPI polypeptide fragments) are identified, for example, by aligning a polypeptide's amino acid sequence with SEQ ID NO: 4234. While, in one embodiment, the peptide comprising TFPI KD1 does not comprise other regions of the TFPI protein responsible for TFPI activity, other embodiments entail the use of a peptide comprising amino acids 1-160 of human TFPI (comprising KD1 and KD2) or comprising full length human TFPI (containing KD1-KD3).

Binding of a test compound to the TFPI binding site defined herein is detected using any of a number methods, including the detection methods described herein. An exemplary method for detecting binding employs nuclear magnetic resonance (NMR) to recognize chemical shifts at amino acid residues within the TFPI binding site. Chemical shifts at TFPI amino acid positions 28-30, 32, 46, 47, and 55, and optionally positions 27, 31, 36-38, and 44, denotes interaction of the test compound with these amino acid contact points on TFPI. Similarly, chemical shifts at TFPI amino acid positions 41, 53, 59, 60, 96, 106, 130, 133, 136, 137, 142, 63, 65, 67, 71, 74, 75, 80, 82-85, 87, 131, 134, 145, and 146 denotes interaction of a test compound with these amino acid contact points on TFPI. To determine the presence or absence of chemical shifts at particular amino acids resulting from test compound binding, NMR data obtained from the KD1-test compound complex is compared to NMR data obtained from free TFPI peptide (e.g., free KD1 peptide or free KD1-KD2 peptide). Use of NMR to detect binding between a test compound and TFPI is further described in the Examples.

Alternatively, binding of a test compound to the TFPI-binding site defined herein is determined indirectly by detecting alterations in the ability of TFPI KD1, optionally in combination with KD2, to interact with its natural binding partners, e.g., FVIIa or FXa. In this regard, the method, in one aspect, comprises contacting the peptide comprising TFPI KD1 with FVIIa in the presence of the test compound under conditions that allow binding of KD1 to FVIIa, and KD1-FVIIa binding is compared with KD1-FVIIa binding in the absence of the test compound. Alternatively or in addition, the method comprises contacting the peptide comprising TFPI KD1 with FXa in the presence of the test compound under conditions that allow binding of KD1 to FXa, and comparing KD1-FXa binding in the presence of the test compound with KD1-FXa binding in the absence of the test compound. Optionally, the peptide comprising KD1 also comprises KD2, and the method comprises contacting the peptide with FXa in the presence of a test compound under conditions that allow binding of KD2 to FXa, and KD2-FXa binding is compared with KD2-FXa binding in the absence of the test compound. A decrease in KD1-FVIIa binding, KD1-FXa binding, or KD2-FXa binding in the presence of the test compound (compared to KD1-FVIIa binding, KD1-FXa binding, or KD2-FXa binding in the absence of the test compound) indicates that the test compound is a TFPI-binding compound. The method optionally comprises contacting KD1 and/or KD2 to FVIIa and/or FXa in the absence of the test compound as a reference for comparing binding in the presence of the test compound.

KD binding to FVIIa or FXa is determined and/or quantified using any suitable method for detecting protein-protein interactions, such as the methods described herein using detectable labels. Binding of the test compound to the TFPI binding site is, alternatively, detected using an enzymatic assay. FVIIa or FXa enzymatic activity is a suitable surrogate for evaluating binding of the proteins to TFPI KD1 or KD2; test compounds that bind the TFPI-binding site defined herein inhibit TFPI activity, resulting in increased FVIIa and FXa activity. Enzymatic assays for evaluating FVIIa or FXa activity are described in detail herein.

The invention further includes compounds identified as TFPI-binding compounds in the methods of the invention, as well as compositions comprising one or more identified compounds. Methods for isolating or purifying a compound, such as TFPI-binding compound (e.g., a TFPI-binding peptide) identified as described herein are known in the art and described above. In some aspects, TFPI-binding compounds identified as described herein are TFPI inhibitors that down-regulate or ablate one or more TFPI activities. The invention provides a TFPI inhibitor that binds human TFPI at a first binding site defined by amino acid residues F28, K29, A30, D32, I46, F47, and I55 (e.g., a binding site defined by amino acid residues A27, F28, K29, A30, D31, D32, K36, I38, I46, F47, and I55, such as a binding site defined by amino acid residues A27, F28, K29, A30, D31, D32, K36, A37, I38, F44, I46, F47, and I55) and a second binding site defined by amino acid residues R41, Y53, C59, E60, Q63, R65, E67, E71, K74, M75, N80, N82, R83, I84, I85, T87, F96, C106, C130, L131, N133, M134, N136, F137, E142, N145, and I146. The amino acid designations correspond to amino acid residue positions in human TFPI. In various aspects, the TFPI inhibitor is a peptide. The TFPI inhibitor, in various embodiments, comprises a first peptide and a second peptide linked by a linker moiety as described herein.

In one embodiment, the invention includes a method for purifying a compound that inhibits FXa activity. The method comprises contacting a peptide comprising TFPI KD1 with a compound under conditions that allow formation of compound-KD1 complexes, removing unbound compound, and dissociating the compound-KD1 complexes to release the compound, which binds TFPI. Use of a TFPI inhibitor identified and/or purified as described herein for the manufacture of a medicament, such as a medicament for treating a blood coagulation disorder, is provided, as well as a method for treating a subject suffering from a disease or at risk of suffering from a disease comprising administering the TFPI inhibitor to the subject.

In addition, a method of inhibiting human TFPI is provided, wherein the method comprises contacting human TFPI with an inhibitor that binds human TFPI at a binding site defined by amino acid residues Phe28, Lys29, Ala30, Asp32, Ile46, Phe47, and Ile55. Another aspect of the invention includes a method for treating a subject suffering from a disease or at risk of suffering from a disease. The method comprises administering to the subject an inhibitor that binds human TFPI at a binding site defined by amino acid residues Phe28, Lys29, Ala30, Asp32, Ile46, Phe47, and Ile55. In one aspect, the human TFPI binding site is defined by amino acid residues Ala27, Phe28, Lys29, Ala30, Asp31, Asp32, Lys36, Ile38, Ile46, Phe47, and Ile55, such as a binding site defined by amino acid residues Ala27, Phe28, Lys29, Ala30, Asp31, Asp32, Lys36, Ala37, Ile38, Phe44, Ile46, Phe47, and Ile55. Alternatively or in addition, the method of inhibiting TFPI comprises contacting human TFPI with an inhibitor that binds human TFPI at a binding site defined by amino acid residues R41, Y53, C59, E60, Q63, R65, E67, E71, K74, M75, N80, N82, R83, I84, I85, T87, F96, C106, C130, L131, N133, M134, N136, F137, E142, N145, and I146. The invention further provides a method of treating a subject suffering from, or at risk of suffering from, a disease, the method comprising administering to a subject an inhibitor that binds human TFPI at a binding site defined by amino acid residues R41, Y53, C59, E60, Q63, R65, E67, E71, K74, M75, N80, N82, R83, I84, I85, T87, F96, C106, C130, L131, N133, M134, N136, F137, E142, N145, and I146. In various aspects, the inhibitor binds TFPI at a binding site defined by amino acid residues F28, K29, A30, D32, I46, F47, and I55 (and optionally A27, D31, K36, A37, I38, and F44) and a binding site defined by amino acid residues R41, Y53, C59, E60, F96, C106, C130, N133, N136, F137, E142, Q63, R65, E67, E71, K74, M75, N80, N82, R83, I84, I85, T87, L131, M134, N145, and I146.

Any inhibitor that contacts the TFPI binding site(s) defined herein and inhibits (downregulates or ablates) one or more TFPI activity is suitable for use in the context of the method. The TFPI inhibitor is, optionally, a TFPI-binding peptide, such as a TFPI-binding peptide having the characteristics described herein.

The invention further includes computer storage media and methods for modeling candidate TFPI-compounds in the TFPI binding site defined herein. Three dimensional (3D) modeling of proteins can be used in conjunction with 3D models of various test TFPI-binding compounds (e.g., peptides or small molecules) to determine fit between the compounds and targeted amino acids in TFPI. Because the effectiveness of a test compound in inhibiting TFPI can be limited if the compound does not remain attached to TFPI for a sufficient period of time to effect a biological response, the tendency of the two to remain coupled can be predicted to develop an affinity rating.

By analyzing the 3D surface of the TFPI protein and the fit of the corresponding compound to the surface in view of the affinity rating, modifications to the compound (e.g., peptide) can be developed to improve both the number of contact points between the surface and the compound and the strength of the bonds at the contact points. The effectiveness of chemical-based candidates and peptide-based TFPI inhibitors can similarly be modeled using this technique, which facilitates the rational design of TFPI-binding compounds. A computer model of the three dimensional (3D) surface of KD1 (optionally linked to KD2) allows testing of the ability of various peptides or chemicals to attach to an identified subset of amino acids that define a TFPI binding site and inhibit KD1 (and, optionally, KD2). In one aspect, a surface of the KD1 protein is modeled in 3D space on a computer, particularly a surface bounded by the targeted amino acids in KD1. The 3D models of various peptides, for example, can be matched to the surface to determine how many of the target TFPI amino acids are contacted by the peptide and also to develop an affinity rating predicting how long the peptide will remain attached to the target surface.

By changing the peptide model and repeating the computer modeling, affinity ratings can be quickly generated for a peptide family. The most promising peptide variants (e.g., a second peptide comprising one or more substitutions within the amino acid sequence of a parent peptide) can be singled out for further physical testing, if desired.

The invention provides a computer storage media having computer executable instructions that, when executed on the processor of a computer, implement a method of modeling interaction between selected three dimensional (3D) points in a TFPI KD1 protein and a test compound. The method comprises obtaining a protein structure 3D model for the TFPI KD1 protein; determining a 3D relationship between a selected subset of amino acids in the protein structure, wherein the selected subset of amino acids comprises Phe28, Lys29, Ala30, Asp32, Ile46, Phe47, and Ile55; modeling a surface bounded by the selected subset of amino acids; obtaining a test compound 3D model of a test compound; matching the test compound 3D model to the surface bounded by the selected subset of amino acids; and identifying contact points between the selected subset of amino acids of the surface and the test compound 3D model. Optionally, the method further comprises determining a number of the contact points between the surface and the test compound 3D model; and recording an affinity rating for the test compound 3D model corresponding to the number of contact points. In one aspect, the selected subset of amino acids comprises (or consists of) Ala27, Phe28, Lys29, Ala30, Asp31, Asp32, Lys36, Ala37, Ile38, Phe44, Ile46, Phe47, and Ile55. The method further optionally comprises obtaining an updated test compound 3D model based on a second test compound; matching the updated test compound 3D model to the surface bounded by the selected subset of amino acids; and identifying the identified contact points between the selected subset of amino acids of the surface and the updated test compound 3D model on a display of the computer. In one embodiment, the method further comprises determining a number of the contact points between the surface and the updated test compound 3D model; determining a bond type for each contact point between the surface and the updated test compound 3D model; and recording a new affinity rating based on the number of contact points and an aggregate of the bond types for each contact point between the surface and the updated test compound 3D model. The updated affinity rating is then compared with the new affinity rating to determine whether the test compound or the second test compound has a higher affinity rating, if desired. The contact points can be displayed on the computer, thereby facilitating optimization or design of TFPI-binding compounds.

Additionally, the invention provides a computer storage media having computer executable instructions that, when executed on the processor of a computer, implement a method of modeling interaction between selected three dimensional (3D) points in a TFPI KD1-KD2 protein and a test compound. The method comprises obtaining a protein structure 3D model for the TFPI KD1-KD2 protein region; determining a 3D relationship between a selected subset of amino acids in the protein structure, wherein the selected subset of amino acids comprises R41, Y53, C59, E60, F96, C106, C130, N133, N136, F137, E142, Q63, R65, E67, E71, K74, M75, N80, N82, R83, I84, I85, T87, L131, M134, N145, and I146; modeling a surface bounded by the selected subset of amino acids; obtaining a test compound 3D model of a test compound; matching the test compound 3D model to the surface bounded by the selected subset of amino acids; and identifying contact points between the selected subset of amino acids of the surface and the test compound 3D model. The method also optionally further comprises determining a number of the contact points between the surface and the test compound 3D model; and recording an affinity rating for the test compound 3D model corresponding to the number of contact points. In various embodiments, the method comprises determining a 3D relationship between a selected subset of amino acids comprising F28, K29, A30, D32, I46, F47, and I55 (and, optionally A27, D31, K36, A37, I38, and/or F44), as well as R41, Y53, C59, E60, Q63, R65, E67, E71, K74, M75, N80, N82, R83, I84, I85, T87, F96, C106, C130, L131, N133, M134, N136, F137, E142, N145, and I146.

In another embodiment, the computer storage media has computer executable instructions that, when executed on the processor of a computer, implement a method of comparing a peptide to selected three dimensional points (3D) in a TFPI Kunitz domain 1 protein (KD1), the method comprising creating a protein structure for the KD1 protein; determining a three dimensional model of a selected subset of amino acids in the KD1 protein, wherein the subset of amino acids comprises Phe28, Lys29, Ala30, Asp32, Ile46, Phe47 and Ile55; determining a three dimensional model of a peptide; fitting the 3D model of the peptide to the 3D model of the selected subset of amino acids; and generating an affinity of the peptide for the selected subset of amino acids, wherein the affinity is based on a number of amino acids in the subset in contact with the peptide and a bond strength at each contact point. Alternatively, the computer executable instructions implement a method of comparing a peptide to selected three dimensional points (3D) in a TFPI Kunitz domain 1 and Kunitz domain 2 (KD1-KD2), the method comprising creating a protein structure for the KD1-KD2 protein; determining a three dimensional model of a selected subset of amino acids in the KD1-KD2 protein, wherein the subset of amino acids comprises R41, Y53, C59, E60, Q63, R65, E67, E71, K74, M75, N80, N82, R83, I84, I85, T87, F96, C106, C130, L131, N133, M134, N136, F137, E142, N145, and I146 (optionally in combination with F28, K29, A30, D32, I46, F47, and I55 (and, further optionally in combination with A27, D31, K36, A37, I38, and/or F44)); determining a three dimensional model of a peptide; fitting the 3D model of the peptide to the 3D model of the selected subset of amino acids; and generating an affinity of the peptide for the selected subset of amino acids.

In addition, a method of comparing a test compound to selected three dimensional points in a TFPI KD1 protein or TFPI KD1-KD2 protein is provided. The method comprises creating a protein structure for the KD1 protein in a memory of a computer; determining a three dimensional model of a selected subset of amino acids in the KD1 protein at a processor of the computer, wherein the selected subset of amino acids comprises Phe28, Lys29, Ala30, Asp32, Ile46, Phe47, and Ile55; determining a three dimensional model of a test compound at the processor of the computer; fitting the 3D model of the test compound to the 3D model of the selected subset of amino acids at the processor of the computer; and generating an affinity of the test compound for the selected subset of amino acids at the processor of the computer, wherein the affinity is based on a number of amino acids in the subset in contact with the test compound and a bond strength at each contact point. Alternatively, the method comprises determining a three dimensional model of a selected subset of amino acids in the KD1-KD2 protein at a processor of the computer, wherein the selected subset of amino acids comprises R41, Y53, C59, E60, F96, C106, C130, N133, N136, F137, E142, Q63, R65, E67, E71, K74, M75, N80, N82, R83, I84, I85, T87, L131, M134, N145, and I146, optionally in combination with F28, K29, A30, D32, I46, F47, and I55 (and, further optionally in combination with A27, D31, K36, A37, I38, and/or F44). The method further comprises, in some embodiments, displaying a 3D representation of the fit between the test compound and the 3D model of the selected subset of amino acids and, optionally, repeating the steps described herein for a plurality of test compounds and saving the respective affinities for each of the plurality of test compounds.

Figure 58:
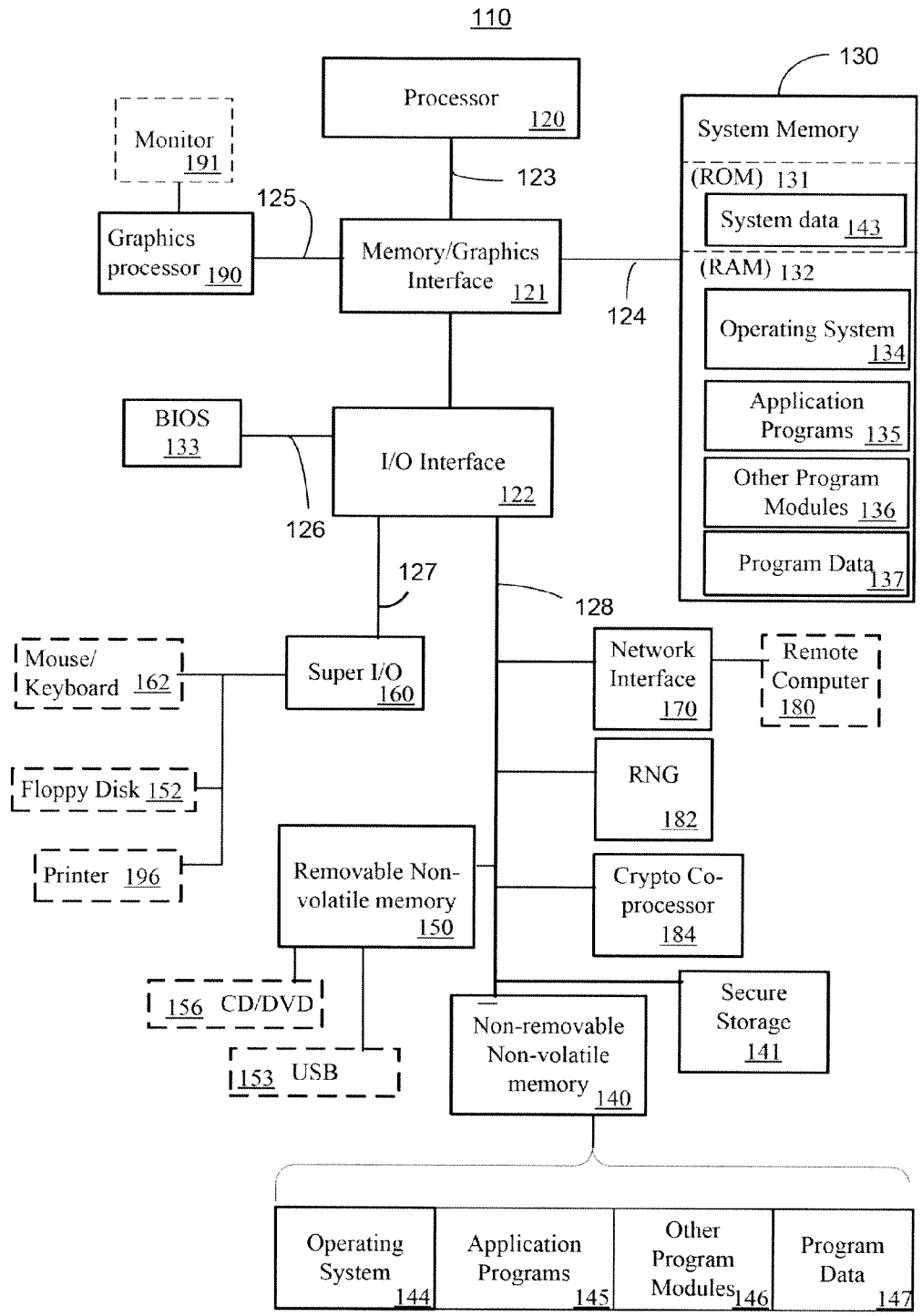
FIG. 58 is an illustration of a computing device.

With reference to FIG. 58, an exemplary system for implementing the claimed method and apparatus includes a general purpose computing device in the form of a computer 110. Components shown in dashed outline are not technically part of the computer 110, but are used to illustrate the exemplary embodiment of FIG. 58. Components of computer 110 may include, but are not limited to, a processor 120, a system memory 130, a memory/graphics interface 121 and an I/O interface 122. The system memory 130 and a graphics processor 190 may be coupled to the memory/graphics interface 121. A monitor 191 or other graphic output device may be coupled to the graphics processor 190.

A series of system busses may couple various system components including a high speed system bus 123 between the processor 120, the memory/graphics interface 121 and the I/O interface 122, a front-side bus 124 between the memory/graphics interface 121 and the system memory 130, and an advanced graphics processing (AGP) bus 125 between the memory/graphics interface 121 and the graphics processor 190. The system bus 123 may be any of several types of bus structures including, by way of example, and not limitation, such architectures include Industry Standard Architecture (USA) bus, Micro Channel Architecture (MCA) bus and Enhanced ISA (EISA) bus. As system architectures evolve, other bus architectures and chip sets may be used but often generally follow this pattern. For example, companies such as Intel and AMD support the Intel Hub Architecture (IHA) and the Hypertransport™ architecture, respectively.

The computer 110 typically includes a variety of computer readable media. Computer readable media can be any available media that can be accessed by computer 110 and includes both volatile and nonvolatile media, removable and non-removable media. By way of example, and not limitation, computer readable media may comprise computer storage media. Computer storage media includes both volatile and nonvolatile, removable and non-removable media implemented in any method or technology for storage of information such as computer executable instructions, data structures, program modules or other data. Computer storage media includes RAM, ROM, EEPROM, flash memory or other memory technology, CD-ROM, digital versatile disks (DVD) or other optical disk storage, magnetic cassettes, magnetic tape, magnetic disk storage or other magnetic storage devices or other physical storage elements that physically embody electronic data and excludes any propagated media such as radio waves or modulated carrier signals.

The system memory 130 includes computer storage media in the form of volatile and/or nonvolatile memory such as read only memory (ROM) 131 and random access memory (RAM) 132. The system ROM 131 may contain permanent system data 143, such as computer-specific configuration data. RAM 132 typically contains data and/or program modules that are immediately accessible to and/or presently being operated on by processor 120. By way of example, and not limitation, FIG. 58 illustrates operating system 134, application programs 135, other program modules 136, and program data 137.

The I/O interface 122 may couple the system bus 123 with a number of other busses 126, 127 and 128 that couple a variety of internal and external devices to the computer 110. A serial peripheral interface (SPI) bus 126 may connect to a basic input/output system (BIOS) memory 133 containing the basic routines that help to transfer information between elements within computer 110, such as during start-up.

A super input/output chip 160 may be used to connect to a number of 'legacy' peripherals, such as floppy disk 152, keyboard/mouse 162, and printer 196, as examples. The super I/O chip 160 may be connected to the I/O interface 122 with a bus 127, such as a low pin count (LPC) bus, in some embodiments. Various embodiments of the super I/O chip 160 are widely available in the commercial marketplace. In one embodiment, bus 128 may be a Peripheral Component Interconnect (PCI) bus.

The computer 110 may also include other removable/non-removable, volatile/nonvolatile computer storage media. By way of example only, FIG. 58 illustrates a hard disk drive 140 that reads from or writes to non-removable, nonvolatile magnetic media. The hard disk drive 140 may be a conventional hard disk drive.

Removable media, such as a universal serial bus (USB) memory 153, firewire (IEEE 1394), or CD/DVD drive 156 may be connected to the PCI bus 128 directly or through an interface 150. Other removable/non-removable, volatile/nonvolatile computer storage media that can be used in the exemplary operating environment include, but are not limited to, magnetic tape cassettes, flash memory cards, digital versatile disks, digital video tape, solid state RAM, solid state ROM, and the like.

The drives and their associated computer storage media discussed above and illustrated in FIG. 58, provide storage of computer readable instructions, data structures, program modules and other data for the computer 110. In FIG. 58, for example, hard disk drive 140 is illustrated as storing operating system 144, application programs 145, other program modules 146, and program data 147. Note that these components can either be the same as or different from operating system 134, application programs 135, other program modules 136, and program data 137. Operating system 144, application programs 145, other program modules 146, and program data 147 are given different numbers here to illustrate that, at a minimum, they are different copies. A user may enter commands and information into the computer 20 through input devices such as a mouse/keyboard 162 or other input device combination. Other input devices (not shown) may include a microphone, joystick, game pad, satellite dish, scanner, or the like. These and other input devices are often connected to the processor 120 through one of the I/O interface busses, such as the SPI 126, the LPC 127, or the PCI 128, but other busses may be used. In some embodiments, other devices may be coupled to parallel ports, infrared interfaces, game ports, and the like (not depicted), via the super I/O chip 160.

The computer 110 may operate in a networked environment using logical communication ports to one or more remote computers, such as a remote computer 180 via a network interface controller (NIC) 170. The remote computer 180 may be a personal computer, a server, a router, a network PC, a peer device or other common network node, and typically includes many or all of the elements described above relative to the computer 110. The logical connection between the NIC 170 and the remote computer 180 depicted in FIG. 58 may include a local area network (LAN), a wide area network (WAN), or both, but may also include other networks. Such networking environments are commonplace in offices, enterprise-wide computer networks, intranets, and the Internet.

Figure 59:
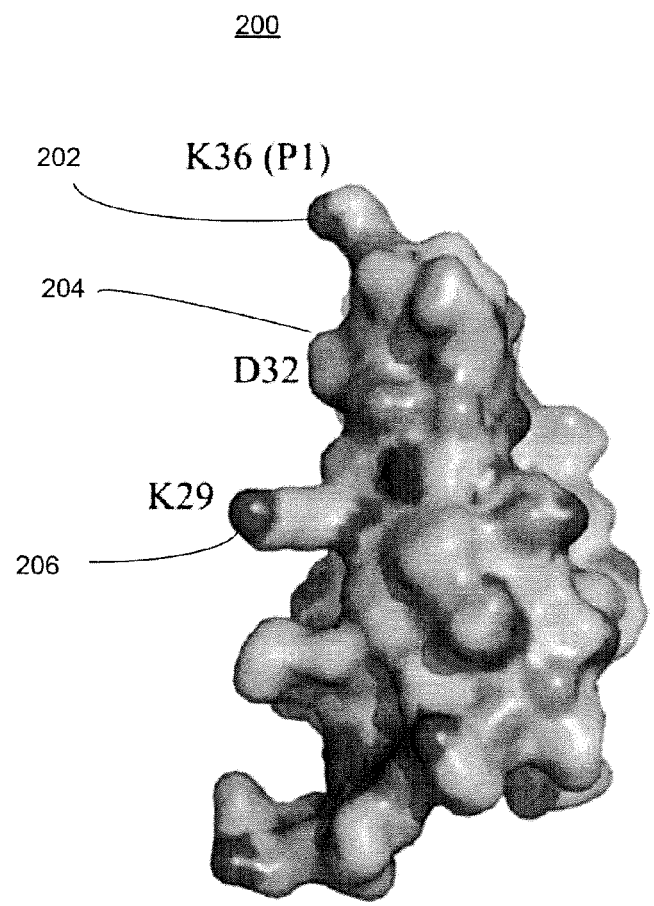
FIG. 59 is an illustration of a three dimensional (3D) model of a KD1 protein.
Figure 60:
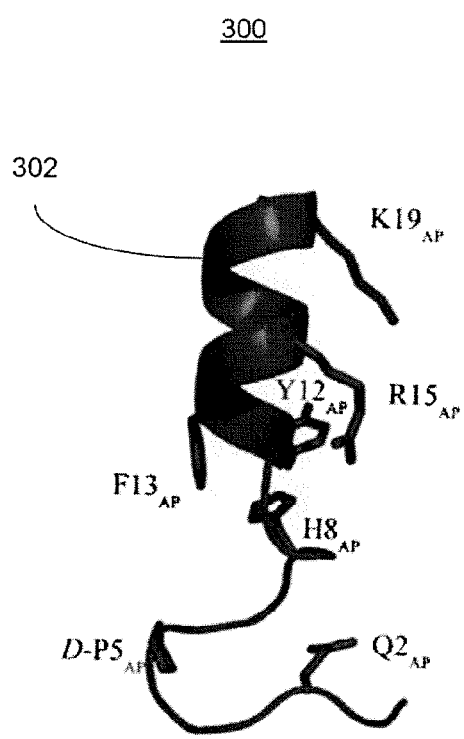
FIG. 60 is an illustration of a 3D model of a TFPI-binding peptide.
Figure 61:
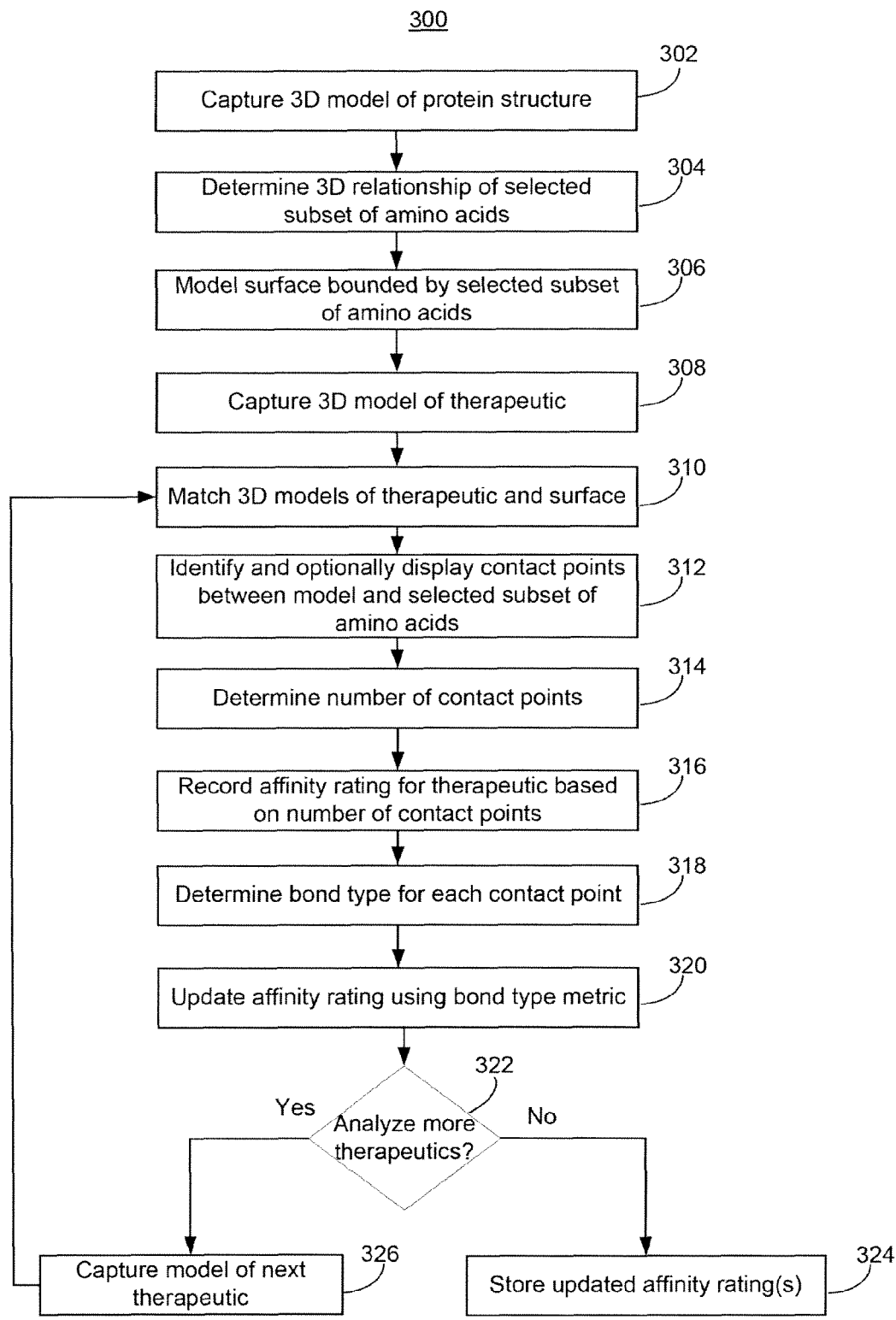
FIG. 61 is an illustration of a method of modeling protein and peptide interaction.

FIG. 59 illustrates a 3D model of a TFPI protein 200 showing representative amino acids 202, 204, 206 that comprise the TFPI protein. A specific region of the TFPI protein of interest is KD1, not specifically illustrated. The surface shown is formed by the placement of the amino acids making up the protein. The surface of formed by specific amino acids in the KD1 region are of interest when studying or creating a TFPI inhibitor. As discussed in more detail herein, the biological effects of KD1 are inhibited by binding certain amino acids of within the KD1 region. Specifically, these target amino acids include Ala27, Phe28, Lys29, Ala30, Asp31, Asp32, Lys36, Ala37, Ile38, Phe44, Ile46, Phe47, and Ile55.

FIG. 60 illustrates a peptide 300 that binds to at least a portion of the target amino acids listed above.

FIG. 61 is an illustration of a method of performing KD1 and peptide interaction modeling.

A 3D model of a protein may be obtained (block 302) and stored on a memory 140 of a computer 110. The model may be generated locally using a known tool or may be obtained from a public source. In one embodiment the protein is TFPI KD1 200.

A 3D relationship between a selected subset of amino acids in the protein structure may be determined (block 304). In one embodiment, the selected subset of amino acids comprises Phe28, Lys29, Ala30, Asp32, Ile46, Phe47 and Ile55; and optionally further comprises Ala27, Asp31, Lys36, and Ile38; and optionally further comprises Ala37 and Phe44. Alternatively or in addition, the selected subset of amino acids comprises R41, Y53, C59, E60, Q63, R65, E67, E71, K74, M75, N80, N82, R83, I84, I85, T87, F96, C106, C130, L131, N133, M134, N136, F137, E142, N145, and I146. Not every amino acid listed here is required for binding to have an inhibitory (e.g., therapeutic) effect. That is, further subsets of this group may also have properties of interest.

For the particular subset of amino acids of interest, a surface bounded by the selected subset of amino acids may be modeled. An outer perimeter may be defined by those amino acids not having further amino acids of interest on each side. A texture of the surface may be defined by the 3D location of each amino acid in the subset (block 306).

A 3D model of a candidate TFPI-binding compound (e.g., peptide) of interest may be generated and stored at a memory 140 of the computer 110 (block 308).

The peptide 3D model may be matched or fitted to the surface bounded by the selected subset of amino acids (block 310). A best fit between the two may be developed at the points of interest, that is, on the selected amino acids of KD1. Several computer tools are available for such 3D modeling and fitting and may be used to create 3D models and match one to another. One example is the HADDOCK tool described in: "de Vries, S. J., van Dijk, A. D. J., Krzeminski, M., van Dijk, M., Thureau, A., Hsu, V., Wassenaar, T. and Bonvin, A. M. J. J. (2007), HADDOCK versus HADDOCK: New features and performance of HADDOCK2.0 on the CAPRI targets. Proteins: Structure, Function, and Bioinformatics, 69: 726-733. doi: 10.1002/prot.21723"

The contact points between the model of the surface of the selected subset of amino acids of the surface and the test compound (e.g., peptide) 3D model may be identified, stored, and optionally displayed on a monitor 191 of the computer 110 (block 312). A compound (e.g., peptide) may be modified to increase the number of contact points or the strength of the bonds at the contact points. To facilitate modeling this effect, a metric, described further below, may be developed to measure the affinity of the compound to bind to the protein of interest, in our example, KD1.

Further, the contact points between the surface and the compound 3D model may be counted (block 314) and an affinity rating for the compound 3D model may be recorded corresponding to the number of contact points (block 316). For example, if all 14 of the above listed amino acids are targeted and 12 of the 14 are actually contacted, or bound, by the compound 3D model, an affinity rating of 12/14 or 0.86 may be calculated and recorded.

However, the affinity rating as a measure of how tightly a candidate compound is coupled, and therefore, how long it may stay coupled to KD1 may be more accurately described in terms of not only the number of bonds of interest but also the type of bond. The bond type for each contact point may also be determined (block 318). With respect to TFPI-binding peptides, hydrophobic bonds having an intermolecular distant of ≤4 angstroms may be differentiated from bonds with an intermolecular distance of 2.6-3.2 angstroms. In one embodiment, bonds less than 3.2 angstroms may be assigned a weight of 1.5 and bonds >than 3.2 angstroms may be assigned a weight of 1.25. The affinity rating may be updated or recalculated in view of the bond type using this, or another weighting (block 320). For example, if, in the previous example, 5 of the bonds are short bonds and 7 of the bonds are long bonds, the new affinity rating may be (5*1.5+7*1.25)/14=1.16.

If only 7 amino acids from KD1 are targeted and 4 connect with short bonds, the affinity rating may be (4*1.5)/7=0.86. However, in this case the fewer targeted amino acids will be considered when comparisons are made to other affinity ratings. For example, all ratings could be normalized to a standard based on total desired target sites.

If no more iterations are to be performed the no branch from block 322 may be taken and the results of may be stored for future analysis and decision making (block 324). If additional peptides, or variants of the previously tested peptide, are to be analyzed, the yes branch from block 322 may be taken and a new or updated model of the peptide of interest may be generated or otherwise obtained and stored (block 326). The steps at blocks 310 to 320 may be repeated and the results of the current run may be compared to results from previous runs to determine which peptides/variants have higher affinity ratings and merit more work, including possible physical testing.

The ability to target particular sites with 3D modeling and to generate a comparative rating allows hundreds, if not thousands of samples to be processed and compared with relative ease, avoiding the time and cost of x-ray crystallography. This technique may be particularly applicable to modeling associated with the F28, K29, A30, D32, I46, F47, I55, A27, D31, K36, I38, F2, A37 and F44 amino acids from TFPI KD1 and/or R41, Y53, C59, E60, Q63, R65, E67, E71, K74, M75, N80, N82, R83, I84, I85, T87, F96, C106, C130, L131, N133, M134, N136, F137, E142, N145, and I146 from TFPI KD1-KD2.

All publications, patents and patent applications cited in this specification are herein incorporated by reference as if each individual publication or patent application were specifically and individually indicated to be incorporated by reference. In addition, the entire document is intended to be related as a unified disclosure, and it should be understood that all combinations of features described herein are contemplated, even if the combination of features are not found together in the same sentence, or paragraph, or section of this document. For example, where protein therapy is described, embodiments involving polynucleotide therapy (using polynucleotides/vectors that encode the protein) are specifically contemplated, and the reverse also is true. Although the foregoing invention has been described in some detail by way of illustration and example for purposes of clarity of understanding, it will be readily apparent to those of ordinary skill in the art in light of the teachings of this invention that certain changes and modifications may be made thereto without departing from the spirit or scope of the appended claims. The invention includes, for instance, all embodiments of the invention narrower in scope in any way than the variations specifically mentioned above. With respect to aspects of the invention described as a genus, all individual species are individually considered separate aspects of the invention. With respect to aspects of the invention described or claimed with "a" or "an," it should be understood that these terms mean "one or more" unless context unambiguously requires a more restricted meaning. With respect to elements described as one or more within a set, it should be understood that all combinations within the set are contemplated. Finally, unless a claim element is defined by reciting the word "means" and a function without the recital of any structure, it is not intended that the scope of any claim element be interpreted based on the application of 35 U.S.C. §112, sixth paragraph.

EXAMPLES

The invention, thus generally described, will be understood more readily by reference to the following examples, which are provided by way of illustration and are not intended to limit the invention.

Example 1

The following example describes production, identification, and screening of peptides for binding to TFPI.

Figure 5:
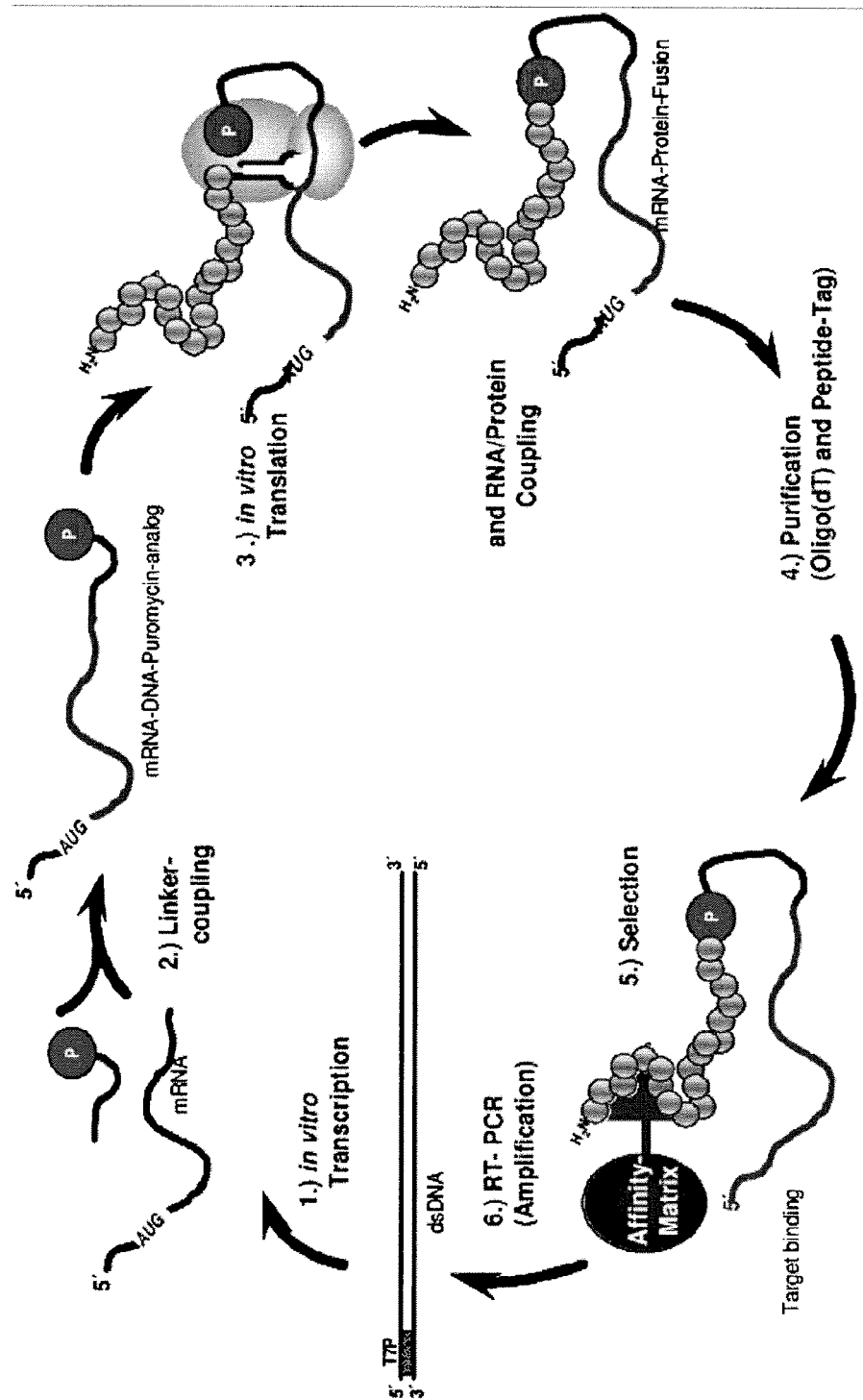
FIG. 5 is an illustration of mRNA display selection of TFPI-binding peptides (e.g., TFPI-inhibitory peptides).

Peptides candidates were obtained from commercial suppliers (e.g., PolyPeptide Laboratories SAS (Strasbourg, France) and JPT Peptide Technologies GmbH (Berlin, Germany)). Methods for synthesizing candidate peptides are provided above. Candidate peptides were synthesized as trifluoroacetate (TFA) salts with a purity >90% or >60%. All peptides were solved in DMSO to a stock concentration of 10 mM. TFPI-binding peptide sequences were identified using an mRNA display library. The mRNA display technology is superior to other library screening techniques for allowing for a diversity of $10^{14}$ different sequences within a starting pool and avoiding, e.g., the in vivo steps required for phage display. In brief, the technology involves directly linking mRNA to its encoded candidate peptide through a puromycin molecule (FIG. 5). The mRNA display method is further described in International Patent Publication No. WO 2005/051985 and Liu et al., *Methods in Enzymology,* 318, 268-293 (2000). TFPI was immobilized to a solid support via biotin and exposed to candidate peptide-RNA complexes. TFPI-bound candidate peptide-RNA complexes were isolated, and the RNA reverse transcribed to obtain coding DNA. High affinity binders were obtained following six to ten selection rounds using a competitive elusion strategy. Many of the candidate peptides were 31 amino acids in length (27 randomized amino acids and 2 amino acids flanking both termini).

Selected peptides were synthesized and subjected to peptide optimization using a microarray-based scan analysis to identify peptide fragments retaining TFPI-binding affinity. For example, a microarray-based scan of JBT0047 was performed using a series of 20 amino acid fragments of the peptide, the sequences of which overlapped by 19 amino acids. Briefly, N-terminally, aminooxyacetate-modified peptides were printed on Corning epoxide glass slides. After washing and drying, the slides were treated in a TECAN HS400™ incubation station. Slides were washed for two minutes in Tris-buffered saline with 0.1% TWEEN 20® (TBST), and blocked for 30 minutes in Tris-based, T-20 SuperBlock™ buffer (5 mM $CaCl_2$) (Pierce). After blocking, the slides were washed for 2.5 minutes in TBST. The slides were subsequently incubated with DYLIGHT™ 649-labeled TFPI (1 μg/ml in Tris-based, T-20 SuperBlock™ buffer (5 mM $CaCl_2$)) for 45 minutes, and washed twice with continuous flow TBST for ten minutes. The slides were subjected to a final wash with saline-sodium citrate buffer for two minutes, and air-dried for four minutes. The slides were scanned in an Axon GenePix® 4000B scanner, and scans were analyzed using the GenePix® Pro software. N- and C-terminal truncation analysis supplemented the scan analysis. The microarray scan results demonstrated that peptide JBT0293 bound TFPI with the highest affinity. A series of substitution mutants based on the amino acid sequence of JBT0293 was generated and tested for TFPI binding properties.

Figures 6A, 6B:
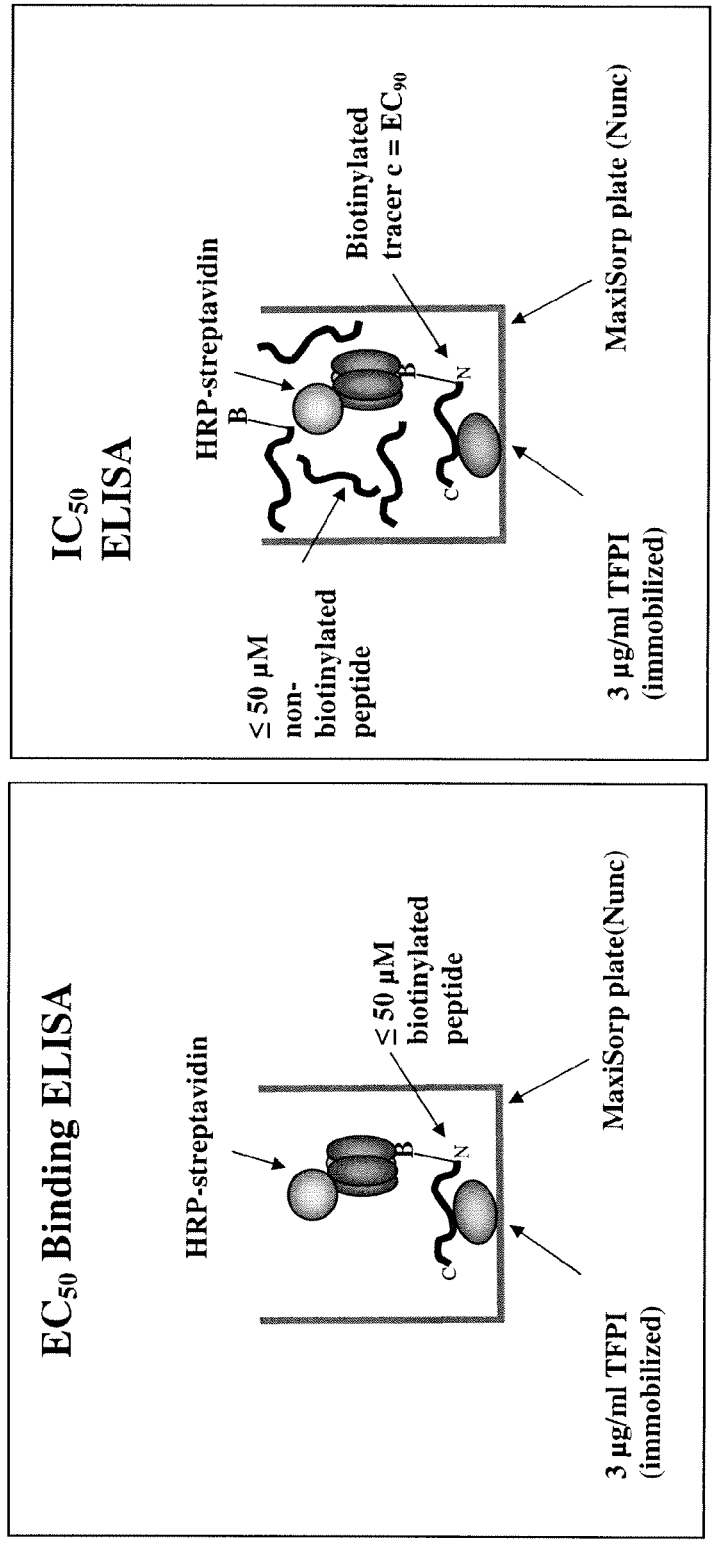
FIG. 6A is an illustration of the $EC_{50}$ binding ELISA and FIG. 6B is an illustration of the $IC_{50}$ ELISA described in Example 1.

The affinity of a subset of peptides for TFPI was demonstrated via an enzyme-linked immunosorbent assay (ELISA)-like assay (binding ($EC_{50}$) ELISA) performed with biotinylated peptides. Ninety-six well MaxiSorp plates (Nunc) were coated with 3 µg/mL TFPI in coating buffer (15 mM Na$_2$CO$_3$, 35 mM NaHCO$_3$, pH 9.6) over night. Plates were washed three times with 350 µl wash buffer (HNaT: 175 mM NaCl, 25 mM HEPES, 5 mM CaCl$_2$, 0.1% Tween 80, pH 7.35), and subsequently blocked with 200 µl 2% yeast extract in HNaT for 2 hours. Plates were then washed three times with 350 µl HNaT. Biotinylated candidate peptides were diluted from a DMSO stock 1/200 in HNaT. The initial peptide concentration was 50 µM if no precipitate appeared during the 1/200 dilution of the 10 mM peptide stock solution. Pre-dilutions of the peptide stock in DMSO were conducted if precipitates formed. The diluted peptides were applied to the Maxisorp plates, serial dilutions (1/3) were generated, and the dilutions were incubated for 1.5 hours at room temperature. Incubation was followed by three wash steps (350 µl HNaT). Bound peptide was detected by incubation with horseradish peroxidase-conjugated streptavidin (1 hour), followed by three wash steps with HNaT and a subsequent chromogenic conversion of added TMB (3,3'5,5'-Tetramethylbenzidin). The assay is illustrated in FIG. 6A.

Figure 7:
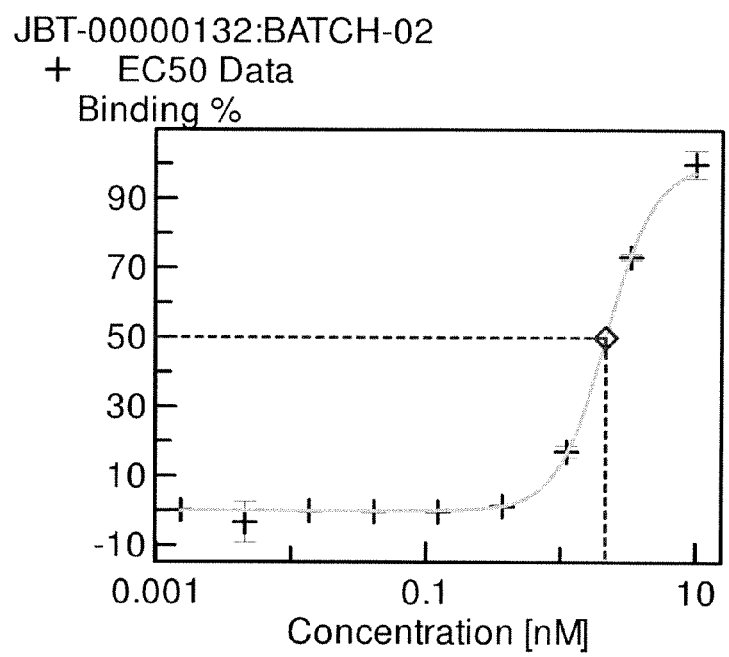
FIG. 7 is a binding ELISA curve comparing % OD (y-axis) and concentration [nM] (x-axis) for biotinylated peptide JBT0132.
Figure 8A:
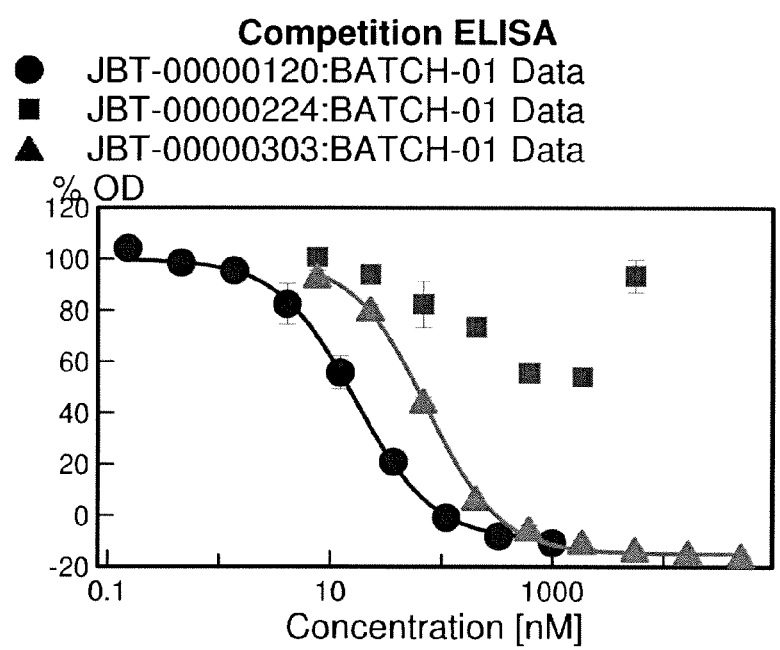
FIGS. 8A-8D are competition ELISA curves comparing % OD (y-axis) and concentration [nM] (x-axis) for exemplary peptides of the invention.
Figure 8B:
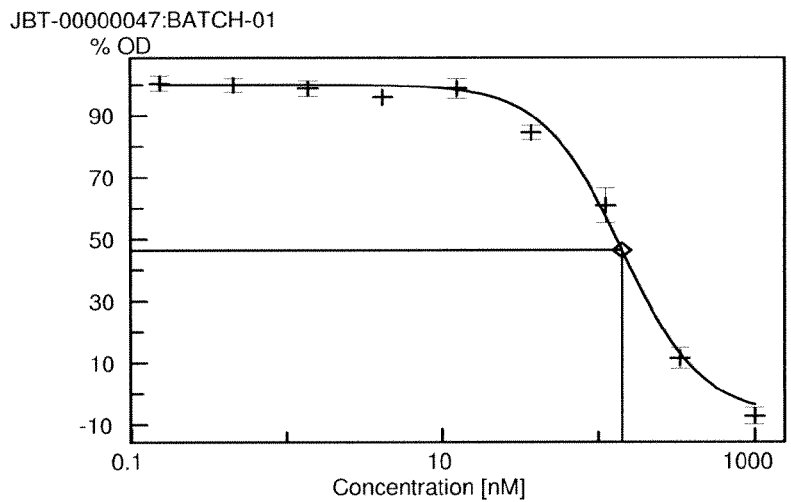
Figure 8C:
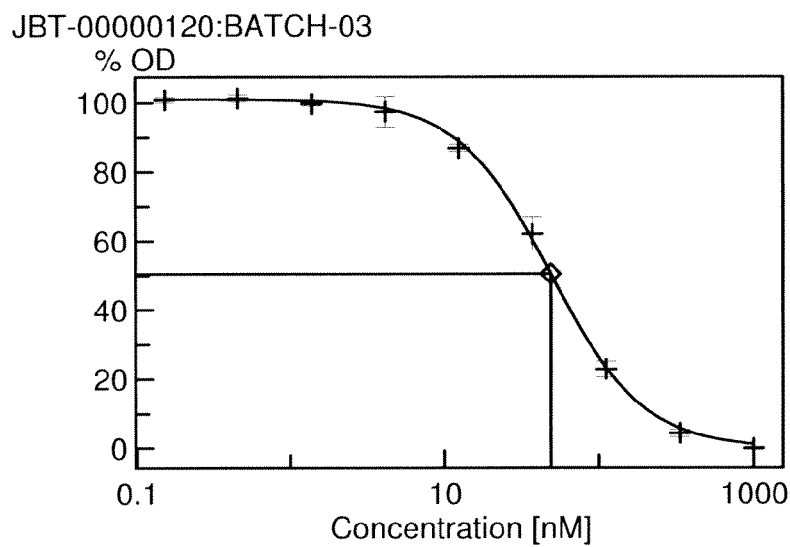
Figure 8D:
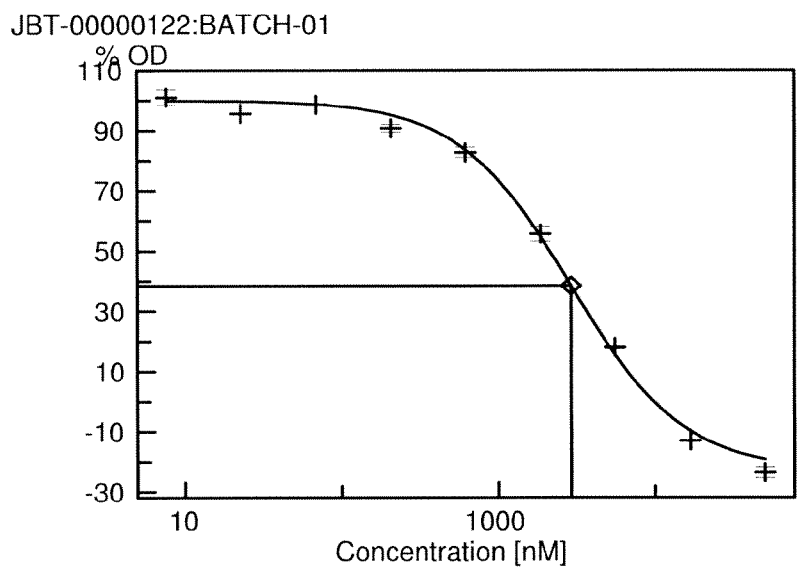

Generally, peptide binding to immobilized TFPI was significantly above background. EC$_{50}$ values for biotinylated peptides are given in FIGS. 32-39. The binding curve of one TFPI-binding peptide, JBT0132, is depicted in FIG. 7. The EC$_{50}$ of JBT0132 was calculated to be about 2.2 nM.

In addition, a competition (IC$_{50}$) ELISA was performed using biotinylated TFPI-binding peptides as "tracers" to compete for TFPI-binding with non-biotinylated candidate peptides. The assay principle is depicted in FIG. 6B. Ninety-six well MaxiSorp plates (Nunc) were coated with 3 µg/mL TFPI in coating buffer (15 mM Na$_2$CO$_3$, 35 mM NaHCO$_3$, pH 9.6) over night. The concentration of TFPI can be altered depending on the particular conditions of the assay; in other IC$_{50}$ ELISA assays referenced herein, the coating buffer contained 0.05 µg/ml TFPI. Plates were washed three times with 350 µl wash buffer (HNaT: 175 mM NaCl, 25 mM HEPES, 5 mM CaCl$_2$, 0.1% Tween 80, pH 7.35), and blocked with 200 µl 2% yeast extract in HNaT for 2 hours. Plates were then washed three times with 350 µl HNaT. Biotinylated tracer peptides were applied at a concentration corresponding to their respective EC$_{90}$ values determined in the binding ELISA (median if n>2). A competitor stock solution of peptide (10 mM) was diluted 1/33.3 in HNaT without HSA, and a serial 1/3 dilution was prepared with HNaT with 3% DMSO. The dilution strategy employed in a particular assay will depend on the affinity of the peptides. The dilution was further diluted with the biotinylated tracer peptide in a ratio of 1:6 (20 µl competitor dilution and 100 µl tracer peptide). The mixture of competitor and tracer peptide was applied to the TFPI-coated microtiter plate and incubated for 1.5 hours. The plates were washed three times with 350 µl HNaT. Peptide-TFPI binding was detected by applying HRP-conjugated streptavidin to the microtiter plate, incubating the mixture for one hour, washing the plate three times with 350 µl HNaT, applying TMB (3,3'5, 5'-Tetramethylbenzidin), and detecting the subsequent chromogenic conversion of TMB by HRP. IC$_{50}$ graphs for representative non-biotinylated peptides are provided in FIGS. 8A-8D. IC$_{50}$ measurements of peptides JBT0303, JBT0120, and JBT0224 are set forth in Table 3.

TABLE 3

| Peptide | IC$_{50}$ [µM] | n | SD | Tracer Peptide | Tracer Concentration [µM] |
|---|---|---|---|---|---|
| JBT0303 | 0.119 | 2 | 0.064 | JBT0131 | 0.0409 |
| JBT0120 | 0.0189 | 3 | 0.0044 | JBT0124 | 0.0718 |
| JBT0224 | n.a. | 1 | | JBT0126 | 0.240 |

In addition to the competition ELISA (IC$_{50}$) assay, a screening assay was employed to measure higher numbers of peptides in parallel. The screening ELISA is similar to the competition IC$_{50}$ ELISA with the exception that only three different concentrations of the competitor were employed (300 nM, 100 nM and 33.3 nM for the JBT0047 class, and 50000 nM, 16667 nM and 5556 nM for the JBT0122 class). In some instances, screening results were expressed as percent inhibition of the tracer signal in relation to a competitive peptide (competitive peptide JBT0477 for the JBT0047 family, and competitive peptide JBT1697 for the JBT0122 family). The competition IC$_{50}$ assay results and the screening assay results of peptides prepared and screened in accordance with the methods set forth herein are provided in FIGS. 32-39. The mean IC$_{50}$ values presented in FIGS. 32-39 are based on a greater number of assays than the values presented in Table 3 and, therefore, the values may differ slightly. The results of the screening ELISA are presented as percent inhibition of tracer peptide JBT0131 binding. Several peptides that were analyzed using the IC$_{50}$ ELISA are classified in FIGS. 32-39 according to their binding affinity as set forth in Table 4.

TABLE 4

| TFPI competition ELISA IC$_{50}$ [nM] | Group |
|---|---|
| <50 nM | A |
| 50 ≤ x <100 nM | B |
| 100 ≤ x <250 nM | C |
| 250 ≤ x <1000 nM | D |
| 1000 ≤ x <5000 nM | E |
| 5000 ≤ x <10000 nM | F |
| 10000 ≤ x <50000 nM | G |

Exemplary TFPI-binding peptides identified using the methods described herein are presented in Table 5. Some peptides were biotinylated, and many comprise N- and C-terminal lysines to promote solubility. Several peptides exhibited TFPI-inhibitory activity in model and/or plasmatic assay systems, as described below.

TABLE 5

| Peptide | Parent | Sequence | SEQ ID |
|---|---|---|---|
| | JBT0047 | QSKKNVFVFGYFERLRAK | 1 |
| JBT0047 | JBT0047 | Ac-SGVGRLQVAFQSKKNVFVFGYFERLRAKLTS-NH2 | 253 |
| JBT0051 | JBT0047 | Biotinyl-Ttds-SGVGRLQVAFQSKKNVFVFGYFERLRAKLTS-NH2 | 962 |
| JBT0055 | JBT0047 | Ac-SGVGRLQVAFQSKKNVFVFGYFERLRAKLTS-Ttds-Lys(Biotinyl)-NH2 | 963 |

TABLE 5-continued

| Peptide | Parent | Sequence | SEQ ID |
|---|---|---|---|
| JBT0131 | JBT0047 | Biotinyl-Ttds-AFQSKKNVFVFGYFERLRAK-NH2 | 964 |
| JBT0132 | JBT0047 | Biotinyl-Ttds-FQSKKNVFVFGYFERLRAKL-NH2 | 965 |
| JBT0133 | JBT0047 | Biotinyl-Ttds-QSKKNVFVFGYFERLRAKLT-NH2 | 966 |
| JBT0155 | JBT0047 | Ac-KKSGVGRLQVAFQSKKNVFVFGYFERLRAKLTSKK-NH2 | 8 |
| JBT0158 | JBT0047 | Ac-KKSGVGRLQVAFQSKKNVFVFGYFERLRAKKK-NH2 | 9 |
| JBT0162 | JBT0047 | Ac-KKGRLQVAFQSKKNVFVFGYFERLRAKLTSKK-NH2 | 10 |
| JBT0163 | JBT0047 | Ac-KKQVAFQSKKNVFVFGYFERLRAKLTSKK-NH2 | 11 |
| JBT0164 | JBT0047 | Ac-KKFQSKKNVFVFGYFERLRAKLTSKK-NH2 | 12 |
| JBT0166 | JBT0047 | Biotinyl-Ttds-KKFQSKKNVFVFGYFERLRAKLKK-NH2 | 968 |
| JBT0169 | JBT0047 | Ac-KKAFQSKKNVFVFGYFERLRAKKK-NH2 | 254 |
| JBT0170 | JBT0047 | Ac-KKFQSKKNVFVFGYFERLRAKLKK-NH2 | 13 |
| JBT0171 | JBT0047 | Ac-KKQSKKNVFVFGYFERLRAKLTKK-NH2 | 255 |
| JBT0174 | JBT0047 | Ac-KKAFQSKKNVFVFGYFERLRAKLKK-NH2 | 14 |
| JBT0175 | JBT0047 | Ac-KKAFQSKKNVFVFGYFERLRAKLTKK-NH2 | 182 |
| JBT0293 | JBT0047 | Ac-FQSKKNVFVFGYFERLRAKL-NH2 | 256 |
|  |  | $X_3X_4X_5KX_7NVFX_{11}X_{12}GYX_{15}X_{16}RLRAKX_{22}$ | 2 |
| JBT0294 | JBT0047 | Ac-YQSKKNVFVFGYFERLRAKL-NH2 | 257 |
| JBT0295 | JBT0047 | Ac-FSSKKNVFVFGYFERLRAKL-NH2 | 713 |
| JBT0296 | JBT0047 | Ac-FQNKKNVFVFGYFERLRAKL-NH2 | 407 |
| JBT0297 | JBT0047 | Ac-FQSKNNVFVFGYFERLRAKL-NH2 | 183 |
| JBT0298 | JBT0047 | Ac-FQSKQNVFVFGYFERLRAKL-NH2 | 747 |
| JBT0299 | JBT0047 | Ac-FQSKKNVFAFGYFERLRAKL-NH2 | 408 |
| JBT0300 | JBT0047 | Ac-FQSKKNVFSFGYFERLRAKL-NH2 | 409 |
| JBT0301 | JBT0047 | Ac-FQSKKNVFTFGYFERLRAKL-NH2 | 470 |
| JBT0302 | JBT0047 | Ac-FQSKKNVFVAGYFERLRAKL-NH2 | 258 |
| JBT0303 | JBT0047 | Ac-FQSKKNVFVDGYFERLRAKL-NH2 | 184 |
| JBT0304 | JBT0047 | Ac-FQSKKNVFVLGYFERLRAKL-NH2 | 259 |
| JBT0305 | JBT0047 | Ac-FQSKKNVFVQGYELRLRAKL-NH2 | 260 |
| JBT0306 | JBT0047 | Ac-FQSKKNVFVSGYFERLRAKL-NH2 | 185 |
| JBT0307 | JBT0047 | Ac-FQSKKNVFVYGYFERLRAKL-NH2 | 261 |
| JBT0308 | JBT0047 | Ac-FQSKKNVFVFGYKERLRAKL-NH2 | 411 |
| JBT0309 | JBT0047 | Ac-FQSKKNVFVFGYYERLRAKL-NH2 | 412 |
| JBT0310 | JBT0047 | Ac-FQSKKNVFVFGYFDRLRAKL-NH2 | 262 |
| JBT0311 | JBT0047 | Ac-FQSKKNVFVFGYFERLRAKN-NH2 | 748 |
|  |  | TFVDERLLYFLTIGNMGMYAAQLKF | 3 |
| JBT0049 | JBT0049 | Ac-SGNTFVDERLLYFLTIGNMGMYAAQLKFRTS-NH2 | 3025 |
| JBT0053 | JBT0049 | Biotinyl-Ttds-SGNTFVDERLLYFLTIGNMGMYAAQLKFRTS-NH2 | 3006 |
| JBT0057 | JBT0049 | Ac-SGNTFVDERLLYFLTIGNMGMYAAQLKFRTS-Ttds-Lysin(biotin)-NH2 | 3018 |

TABLE 5-continued

| Peptide | Parent | Sequence | SEQ ID |
|---|---|---|---|
| JBT0190 | JBT0049 | Ac-KKSGNTFVDERLLYFLTIGNMGMYAAQLKFRTSKK-NH2 | 3031 |
| JBT0193 | JBT0049 | Ac-KKSGNTFVDERLLYFLTIGNMGMYAAQLKFKK-NH2 | 3073 |
| JBT0197 | JBT0049 | Ac-KKTFVDERLLYFLTIGNMGMYAAQLKFRTSKK-NH2 | 3076 |
| | | VIVFTFRHNKLIGYERRY | 4 |
| JBT0050 | JBT0050 | Ac-SGRGCTKVIVFTFRHNKLIGYERRYNCTS-NH2 | 3047 |
| JBT0054 | JBT0050 | Biotinyl-Ttds-SGRGCTKVIVFTFRHNKLIGYERRYNCTS-NH2 | 3002 |
| JBT0058 | JBT0050 | Ac-SGRGCTKVIVFTFRHNKLIGYERRYNCTS-Ttds-Lysin(biotin)-NH2 | 3003 |
| JBT0129 | JBT0050 | Ac-SGRG[CTKVIVFTFRHNKLIGYERRYNC]TS-NH2 | 3026 |
| JBT0130 | JBT0050 | Biotinyl-Ttds-SGRG[CTKVIVFTFRHNKLIGYERRYNC]TS-NH2 | 3001 |
| JBT0205 | JBT0050 | Ac-KKSGRGCTKVIVFTFRHNKLIGYERRYNCTSKK-NH2 | 3029 |
| JBT0208 | JBT0050 | Ac-KKSGRGCTKVIVFTFRHNKLIGYERRYNKK-NH2 | 3027 |
| JBT0211 | JBT0050 | Ac-KKGCTKVIVFTFRHNKLIGYERRYNCTSKK-NH2 | 3032 |
| JBT0212 | JBT0050 | Ac-KKKVIVFTFRHNKLIGYERRYNCTSKK-NH2 | 3033 |
| JBT0217 | JBT0050 | Ac-KKTKVIVFTFRHNKLIGYERRYKK-NH2 | 3062 |
| JBT0218 | JBT0050 | Ac-KKKVIVFTFRHNKLIGYERRYNKK-NH2 | 3063 |
| JBT0219 | JBT0050 | Ac-KKVIVFTFRHNKLIGYERRYNCKK-NH2 | 3030 |
| | | GVWQTHPRYFWTMWPDIKGEVIVLFGT | 5 |
| JBT0101 | JBT0101 | Ac-KKSGVWQTHPRYFWTMWPDIKGEVIVLFGTSKK-NH2 | 3036 |
| JBT0052 | JBT0101 | Biotinyl-Ttds-KKSGVWQTHPRYFWTMWPDIKGEVIVLFGTSKK-NH2 | 3004 |
| JBT0103 | JBT0101 | Ac-KKSGVWQTHPRYFWTMWPDIKGEVIVLFGTS-Ttds-KK-Lysin(biotinyl)-NH2 | 3005 |
| JBT0178 | JBT0101 | Ac-KKSGVWQTHPRYFWTMWPDIKGEVIVLFGTKK-NH2 | 3028 |
| JBT0182 | JBT0101 | Ac-KKGVWQTHPRYFWTMWPDIKGEVIVLFGTSKK-NH2 | 3037 |
| | | KWFCGMRDMKGTMSCVWVKF | 6 |
| JBT0120 | JBT0120 | Ac-SGASRYKWF[CGMRDMKGTMSC]VWVKFRYDTS-NH2 | 1047 |
| JBT0124 | | Biotinyl-Ttds-SGASRYKWF[CGMRDMKGTMSC]VWVKFRYDTS-NH2 | 1290 |
| JBT0247 | JBT0120 | Ac-SGASRYKWFCGMRDMKGTMSCVWVKFRYDTS-NH2 | 1213 |
| JBT0248 | JBT0120 | Ac-KKSGASRYKWF[CGMRDMKGTMSC]VWVKFRYDTSKK-NH2 | 1001 |
| JBT0251 | JBT0120 | Ac-KKKWFCGMRDMKGTMSCVWVKFKK-NH2 | 1202 |
| JBT0252 | JBT0120 | Ac-KKCGMRDMKGTMSCVWVKFRYDKK-NH2 | 1215 |
| | | ASFPLAVQLHVSKRSKEMA | 7 |
| JBT0122 | JBT0122 | Ac-SGYASFPLAVQLHVSKRSKEMALARLYYKTS-NH2 | 2002 |
| JBT0126 | JBT0122 | Biotinyl-Ttds-SGYASFPLAVQLHVSKRSKEMALARLYYKTS-NH2 | 2498 |
| JBT0221 | JBT0122 | Ac-KKSGYASFPLAVQLHVSKRSKEMALARLYYKTSKK-NH2 | 2003 |
| JBT0224 | JBT0122 | Ac-KKSGYASFPLAVQLHVSKRSKEMALARLYYKK-NH2 | 2298 |
| JBT0225 | JBT0122 | Ac-KKSGYASFPLAVQLHVSKRSKEMALARKK-NH2 | 2128 |
| JBT0226 | JBT0122 | Ac-KKSGYASFPLAVQLHVSKRSKEMAKK-NH2 | 2299 |
| JBT0228 | JBT0122 | Ac-KKASFPLAVQLHVSKRSKEMALARLYYKTSKK-NH2 | 2016 |

TABLE 5-continued

| Peptide | Parent | Sequence | SEQ ID |
|---------|--------|----------|--------|
| JBT0232 | JBT0122 | Ac-KKGYASFPLAVQLHVSKRSKEMKK-NH2 | 2303 |
| JBT0233 | JBT0122 | Ac-KKYASFPLAVQLHVSKRSKEMAKK-NH2 | 2304 |

This example provides exemplary methods of generating and characterizing TFPI-binding peptides (e.g., TFPI-inhibitory peptides). All peptides in Table 5 were found to bind human TFPI-1α. Mutation analysis demonstrated that at least one amino acid in a TFPI-binding peptide may be substituted while retaining affinity for TFPI. The peptides of Table 5 tested in ELISA assays bound TFPI-1α with an $EC_{50}$ of less than 10 μM ($1\times10^{-5}$ M) and an $IC_{50}$ of less than 50 μM.

Example 2

Selected TFPI-binding peptides were further characterized in terms of "anti-target" binding. This example demonstrates that TFPI-binding peptides exhibit reduced affinity for non-TFPI-1 proteins.

TFPI-2 was selected as an anti-target because of its similarity to TFPI-1. The binding kinetics of TFPI-binding peptides to human TFPI-1 (residues 29-282 fused at the C-terminus to a 10 His-tag; MW 41 kDa (R&D Systems, Minneapolis, Minn.; catalog number 2974-PI)) murine TFPI-1 (residues 29-289 fused at the C-terminus to a 10 His-tag; MW 41 kDa (R&D Systems; catalogue number 2975-PI)), and TFPI-2 (R&D Systems, Minneapolis, Minn.) were studied using a BIAcore 3000™ surface plasmon resonance assay (GE Healthcare, Chalfont St. Giles, UK). TFPI proteins were immobilized on a C1 chip (GE Healthcare, Order Code: BR-1005-40) by amine coupling chemistry aiming for 500 RU. Several TFPI-binding peptides were employed as analytes for interacting with the immobilized TFPI proteins. A flow rate of 30 μl/min was utilized. After 180 seconds, 180 μl of peptide solution was injected at six different concentrations ranging from 3.84 nM to 656.25 nM, followed by a dissociation time of 480 seconds. The chip was regenerated with 45 μl 10 mM NaOH. Each binding experiment was preceded and followed by four measurements with HBS-P buffer (10 mM HEPES, pH 7.4, 150 mM NaCl, 0.005% P20) plus 1% DMSO and 0.8% P80. BIAevaluation® Version 4.1 software (GE Healthcare) was employed to analyze the data. Sensorgrams were fitted to a 1:1 Langmuir binding curve to determine $k_{on}$ and $k_{off}$ and calculate $K_D$.

Figure 9A:
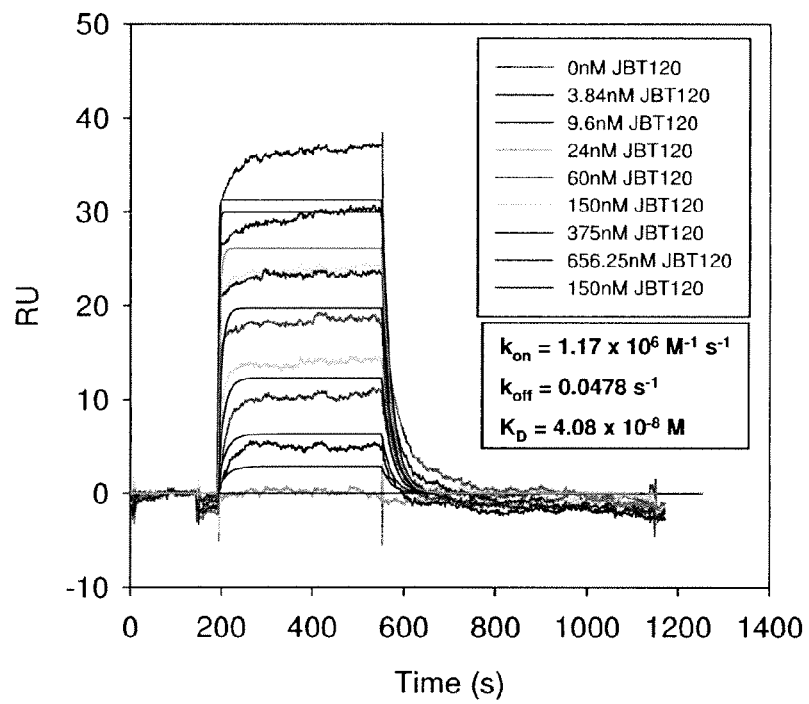
FIGS. 9A and 9B are sensorgrams plotting RU (y-axis) against time in seconds (x-axis) for peptides JBT0120 and JBT0132.
Figure 9B:
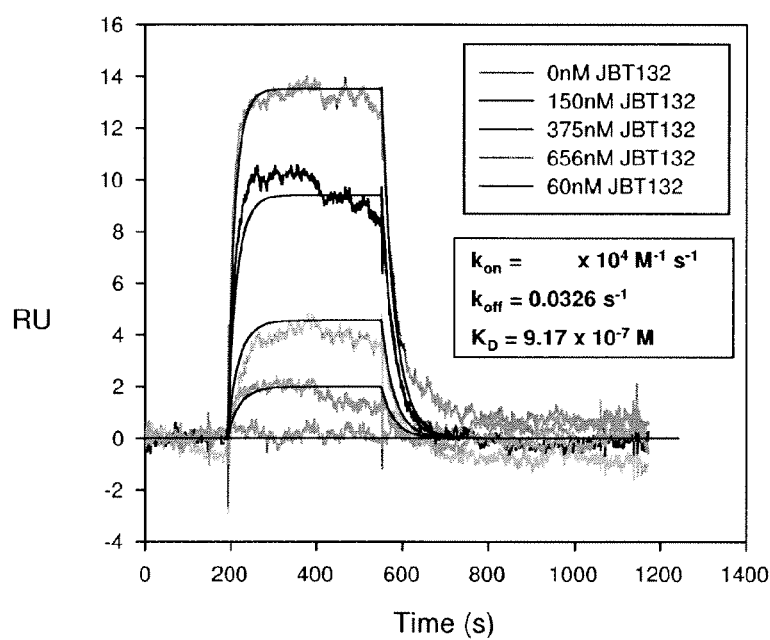

Certain tested peptides, e.g., JBT0050, JBT0121, JBT0205 and JBT0211, bound to the blank cell and binding constants from those sensorgrams could not be determined. JBT0133 showed weak binding to TFPI-1. Sensorgrams from other peptides gave reliable binding constants. Results from BIAcore analysis of several TFPI-binding peptides is provided in Table 6 and FIGS. 19-21. Each of the peptides listed in Table 6 presented a $K_D$ of less than 10 μM. In addition to the peptides listed below, JBT0375 and JBT0477, substitution mutants of JBT0293 at amino acid position 5 (JBT0375) or amino acid positions 5 and 10 (JBT0477), also exhibited a $K_D$ of less than 10 μM. JBT1837 (SEQ ID NO: 1044) also demonstrated a $K_D$ of less than 10 μM ($K_D$=0.5 nM; $k_{on}$= $8\times10^3$ 1/Ms; $k_{off}$=$1.3\times10^{-6}$ 1/s). Sensorgrams of two of the peptides are provided as FIGS. 9A and 9B.

TABLE 6

| Peptide | $k_{on}$ (1/Ms) | $k_{off}$ (1/s) | $K_D$ (M) |
|---------|-----------------|------------------|-----------|
| JBT0047 | $4.0 \times 10^5$ | $1.9 \times 10^{-2}$ | $4.7 \times 10^{-8}$ |
| JBT0120 | $1.17 \times 10^6$ | $4.78 \times 10^{-2}$ | $4.08 \times 10^{-8}$ |
| JBT0131 | $1.4 \times 10^5$ | $6.0 \times 10^{-2}$ | $4.31 \times 10^{-7}$ |
| JBT0132 | $3.55 \times 10^4$ | $3.26 \times 10^{-2}$ | $9.17 \times 10^{-7}$ |
| JBT0224 | $6.39 \times 10^4$ | $1.95 \times 10^{-2}$ | $3.05 \times 10^{-7}$ |
| JBT0293 | $6.0 \times 10^5$ | $5.6 \times 10^{-2}$ | $9.5 \times 10^{-8}$ |
| JBT0297 | $5.0 \times 10^5$ | $1.4 \times 10^{-2}$ | $2.9 \times 10^{-8}$ |
| JBT0303 | $8.13 \times 10^5$ | $2.75 \times 10^{-2}$ | $3.4 \times 10^{-8}$ |
| JBT0305 | $7.5 \times 10^5$ | $3.1 \times 10^{-2}$ | $6.1 \times 10^{-8}$ |

Interaction with the TFPI-2 anti-target also was examined. The maximum signal generated from candidate peptide interaction with human TFPI-2 was much lower than the signals obtained with TFPI-1 as an interaction partner. Kinetic analysis of the low TFPI-2 binding signals was prone to error; therefore, visual comparison of sensorgrams was used to estimate binding affinity. A sensorgram illustrating JBT0120 binding to TFPI-1 and TFPI-2 is provided as FIGS. 10A and 10B. JBT0120 binds TFPI-2 with 10-fold lower affinity compared to its binding affinity for TFPI-1. JBT0132 also was found to exhibit at least 10-fold greater affinity for TFPI-1 than TFPI-2.

The data provided by this example confirm that TFPI-binding peptides specifically bind TFPI-1.

Example 3

The following example describes the characterization of TFPI-inhibitory activity of select peptides identified in Example 1 using FXa inhibition and extrinsic tenase inhibition assays. Both assays are predictive of activity in plasmatic systems. The extrinsic tenase assay gives insight into the influence of the peptides on (a) the interaction of FXa and TFPI and (b) the interaction of the FXa-TFPI complex with the TF-FVIIa complex. The FXa inhibition assay measures a peptide's influence on the interaction of FXa and TFPI only.

The extrinsic tenase complex is responsible for FX and FIX activation upon initiation of the coagulation process. The extrinsic complex is composed of FVIIa, Tissue Factor (TF), and FX substrate. To determine the influence of peptides on the TFPI-mediated inhibition of the extrinsic tenase complex, a coupled enzyme assay was established. Peptides were diluted 1/6.25 from 10 mM stocks (in DMSO) and further diluted by serial 1/4 dilutions in buffer or DMSO to prevent unwanted precipitation. TFPI was diluted in HNaCa-HSA or BSA (25 mM HEPES; 175 mM NaCl; 5 mM $CaCl_2$; 0.1% HSA or BSA; pH 7.35). FVIIa, lipidated TF, phospholipid vesicles (DOPC/POPS 80/20), and chromogenic substrate specific for FXa (S-2222 (available from DiaPharma, West Chester, Ohio)), all diluted in HNaCa-HSA, were added to 96-well plates. After an incubation period, TFPI and peptide dilutions were added, resulting in a final concentration of 2.5% DMSO (if present in the peptide stock). FX activation was initiated by adding FX to the wells. FXa-mediated chromogenic substrate conversion was determined by observing an increase in absorbance using a micro-plate reader. The amount of FXa generated at certain time points was calculated from the OD readings. FXa generated at 20 minutes after start of the reaction was considered for calculation of $EC_{50}$ from plots of peptide concentration versus the inhibition of TFPI (%).

The functional inhibition of TFPI also was examined using a FXa inhibition assay. A FXa-specific chromogenic substrate (S-2222) and TFPI, both diluted in HNaCa-HSA, were added to 96 well plates. Peptides were diluted 1/6.25 from 10 mM stocks (in DMSO or Aqua-Dest) and further diluted by serial 1/4 dilutions in buffer or DMSO to prevent unwanted precipitation. The peptide dilutions (2.5 µl) were added to the 96 well plates, resulting in a final concentration of 2.5% DMSO (if present in the peptide stock). The conversion of chromogenic substrate was triggered by the addition of FXa, and the kinetics of the conversion were measured in a microplate reader. Because TFPI inhibits FXa slowly, OD readings after 115 minutes were considered for calculation of the $EC_{50}$ from plots of peptide concentration versus the inhibition of TFPI (%).

Results from the extrinsic tenase assay and FXa inhibition assay are provided in Table 7 and FIGS. 22-27.

TABLE 7

| | FXa Inhibition Assay | | Extrinsic Tenase Assay | |
|---|---|---|---|---|
| | $EC_{50}$ [µM] | % inhibition @ 2.5 µM | $EC_{50}$ [µM] | % inhibition @ 2.5 µM |
| JBT0120 | 0.9 | 45 | 0.9 | 45 |
| JBT0132 | 1.2 | 36 | 0.1 | 10 |
| JBT0224 | n.a. | 26 | 3.5 | 18 |
| JBT0303 | 1.2 | 61 | n.a. | 8 |

Referring to Table 7, JBT0120, JBT0132, and JBT0224 restored extrinsic complex-mediated FX activation in the presence of TFPI-1 with an $EC_{50}$ of <2 µM, resulting in between about 20% to about 60% inhibition of TFPI activity. JBT0047 ($EC_{50}$=1.4 µM), JBT0131 ($EC_{50}$=2.2 µM), and JBT0293 ($EC_{50}$=2.9 µM) also restored extrinsic complex activity in the presence of TFPI-1. In addition, JBT0120, JBT0132, JBT0224, and JBT0303 restored FXa activity in the presence of TFPI-1 with an $EC_{50}$ of <5 µM, resulting in between about 5% to about 50% inhibition of TFPI activity, in the FXa inhibition assay. JBT0047 ($EC_{50}$=0.7 µM), JBT0131 ($EC_{50}$=8.2 µM), JBT0293 ($EC_{50}$=1.3 µM), JBT0297 ($EC_{50}$=0.6 µM), and JBT0305 ($EC_{50}$=2.3 µM) also restored activity of FXa in the presence of TFPI-1 in the FXa inhibition assay. This example confirms that peptides of the invention are TFPI antagonists.

Example 4

In this example, the TFPI inhibitory activity of peptides is established using a plasma-based assay.

The influence of peptides on thrombin generation was measured in duplicate via calibrated automated thrombography in a Fluoroskan Ascent® reader (Thermo Labsystems, Helsinki, Finland; filters 390 nm excitation and 460 nm emission) following the slow cleavage of the thrombin-specific fluorogenic substrate Z-Gly-Gly-Arg-AMC (Hemker, *Pathophysiol. Haemost. Thromb.*, 33, 4-15 (2003)). Plasma from patients with FVIII or FIX deficiency (George King Bio-Medical Inc., Overland Park, KN) was obtained for testing. The residual coagulation factor activity for each of the plasmas was lower than 1%. As a model for antibody-mediated FVIII deficiency, frozen pooled normal plasma (George King Bio-Medical Inc., Overland Park, KN) was incubated with high titer, heat inactivated, anti-human FVIII plasma raised in goat (4490 BU/ml; Baxter BioScience, Vienna, Austria) giving rise to 50 BU/mL. The plasmas were mixed with corn trypsin inhibitor (CTI) (Hematologic Technologies, Inc., Essex Junction, Vt.) to inhibit Factor XIIa contamination, resulting in a final concentration of 40 µg/mL.

Pre-warmed (37° C.) plasma (80 µL) was added to each well of a 96 well micro-plate (Immulon 2HB, clear U-bottom; Thermo Electron, Waltham, Mass.). To trigger thrombin generation by Tissue Factor, 10 µL of PPP low reagent containing low amounts (12 pM) of recombinant human Tissue Factor and phospholipid vesicles composed of phosphatidylserine, phosphatidylcholine and phosphatidylethanolamine (48 µM) (Thrombinoscope BV, Maastricht, The Netherlands) were added. Peptides were diluted 1/7.5 from 10 mM stocks with DMSO, and further diluted 1/8.33 with Aqua-Dest resulting in a DMSO concentration of 12%, providing a 0.5% DMSO concentration in the final assay mix. Just prior putting the plate into the pre-warmed (37° C.) reader, 5 µL of HEPES buffered saline with 5 mg/mL human serum albumin (Sigma-Aldrich Corporation, St. Louis, Mo., USA) or 12% DMSO in Aqua-Dest was added, followed by addition of the peptide dilutions or reference proteins (FVIII Immunate reference standard (Baxter BioScience, Vienna, Austria); Factor VIII Inhibitor By-Passing Activity (FEIBA) reference standard (Baxter BioScience, Vienna, Austria); NovoSeven (Novo Nordisk, Denmark); and purified human plasma FIX (Enzyme Research Laboratories, South Bend, Ill.)). Thrombin generation was initiated by dispensing into each well 20 µL of FluCa reagent (Thrombinoscope BV, Maastricht, The Netherlands) containing a fluorogenic substrate and HEPES-buffered $CaCl_2$ (100 mM). Fluorescence intensity was recorded at 37° C.

The parameters of the resulting thrombin generation curves were calculated using Thrombinoscope™ software (Thrombinoscope BV, Maastricht, The Netherlands) and thrombin calibrator to correct for inner filter and substrate consumption effects (Hemker, *Pathophysiol. Haemost. Thromb.*, 33, 4-15 (2003)). For calculating the thrombin generating activity of certain peptide concentrations equivalent to the reference proteins (e.g., FVIII Immunate® reference standard, FEIBA reference standard), the thrombin amounts at the peak of each thrombin generation curve (peak thrombin, nM) were plotted against the standard concentrations, and fitted by a non-linear algorithm. Based on this calibration, FVIII Immunate, FIX, FEIBA or NovoSeven equivalent activities were calculated. Results for various peptides are provided in FIGS. 12-18 and 28-30. Representative results are provided in Table 8. (* denotes that FVIII deficient plasma was obtained from a different donor.)

TABLE 8

| | % FVIII-equivalent activity in FVIII deficient plasma @ 10 µM peptide | FEIBA-equivalent activity in FVIII inhibited plasma @ 10 µM peptide [mU/ml] |
|---|---|---|
| JBT0120 | 37.4* | 298 |
| JBT0132 | 5.3 | 41 |
| JBT0224 | 16.2 | 191 |
| JBT0303 | 20.8 | 253 |

Figure 11A:
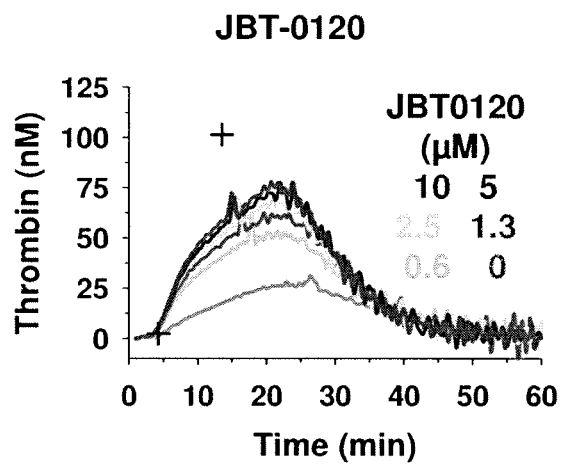
FIGS. 11A and 11B are graphs comparing amount of thrombin generated (nM) (y-axis) and time in minutes (x-axis) for peptide JBT0120 and peptide JBT0132 in a plasma-based assay.
Figure 11B:
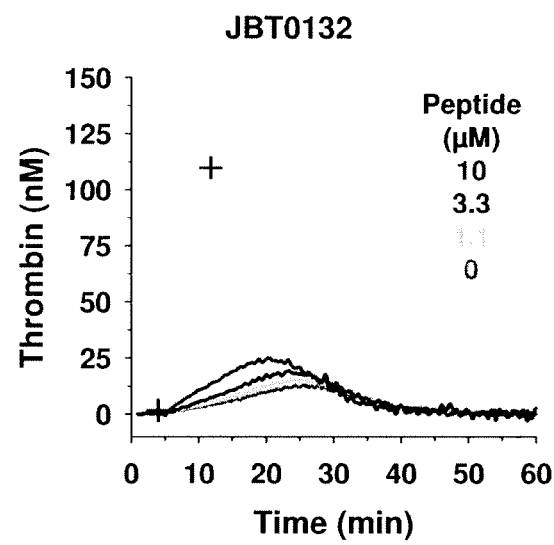

With reference to Table 8, JBT0120, JBT0132, JBT0224, and JBT0303 improved TFPI-dependent thrombin generation in FVIII-depleted plasma to levels exceeding 1% of the level of thrombin generation in plasma containing FVIII (% FVIII-equivalent activity). The tested peptides exhibited approximately 5%-40% FVIII-equivalent activity in FVIII-deficient plasma. JBT0120 and JBT0132 improved peak thrombin and peak time, dose dependently, as illustrated in FIGS. 11A and 11B.

Substitution mutants based on the amino acid sequence of JBT0293 also were tested in a plasma-based assay, as well as the FXa inhibition and extrinsic tenase inhibition assay described in Example 3. Representative results are provided in Table 9.

TABLE 9

| | Biacore $K_D$ (nM) | FXa Inhibition $EC_{50}$ (µM) | Extrinsic Tenase Inhibition $EC_{50}$ (µM) | FVIII-equivalent activity (mU/ml) in Hem A plasma @ 1 µM peptide |
|---|---|---|---|---|
| JBT0047 | 47 | 0.7 | 1.4 | 45 |
| JBT0293 | 97 | 1.3 | 2.9 | 48 |
| JBT0303 | 34 | 1.2 | NA | 125 |
| JBT0500 | 8.2 | 0.12 | — | 372 |
| JBT0740 | 2.4 | 0.07 | — | 333 |
| JBT1584 | 0.3 | 0.01 | — | 489 |

Additionally, JBT0477, which comprises the amino acid sequence of JBT0293 but for substitutions at amino acid positions 5 and 10 of the JBT0293 sequence, improves thrombin generation equivalent to 413 mU/ml of FVIII (at 1 µM of peptide) in FVIII-deficient plasma. Substitution mutation of JBT0293 resulted in highly optimized peptides with respect to affinity for TFPI and improved activity in FXa inhibition, extrinsic tenase inhibition, and plasma-based assays.

Example 5

The following example demonstrates that the peptides of the invention can be modified by the addition of moieties that enhance physicochemical or pharmacokinetic properties of the peptides. As illustrated below, the addition of 40 kDa PEG to peptides described herein dramatically improved the pharmacokinetic behavior of the peptides. The example also describes optimization of a TFPI-binding peptide, JBT1857, to reduce susceptibility to proteolysis.

Methods of conjugating chemical or biological moieties to peptides are known in the art. To add PEG (polyethylene glycol) to the peptides describe herein, a functional group (AOA=aminooxy acetate) was added to the N-terminus of the peptides for coupling to aldehydes and ketones. Alternatively, a cysteine was added to the C-terminal part of the peptide for coupling with maleimid (Hermanson, *Bioconjugate Techniques*, Academic Press (1996)). The peptides (JBT1586) AOA-FQSKGNVFVDGYFERL-Aib-AKL-NH2 (SEQ ID NO: 166) and (JBT1587) Ac-FQSKGNVFVDGYFERL-Aib-AKLC-NH2 (SEQ ID NO: 167) were used for N-terminal and C-terminal modification with PEG, respectively. AOA-FQSKGNVFVDGYFERL-Aib-AKL-NH2 (SEQ ID NO: 166) and Ac-FQSKGNVFVDGYFERL-Aib-AKLC-NH2 (SEQ ID NO: 167) were incubated with excess 40 kDa mPEG-Propionaldehyde (SUNBRIGHT ME-400AL2, NOF, Japan) and 40 kDa mPEG-maleimide (SUNBRIGHT ME-400MA, NOF, Japan), respectively. The resulting PEGylated peptides, JBT1852 and JBT1855, show similar affinities compared to the starting structure Ac-FQSKGNVFVDGY-FERL-Aib-AKL-NH1 (JBT0740) (SEQ ID NO: 66).

Figure 31:
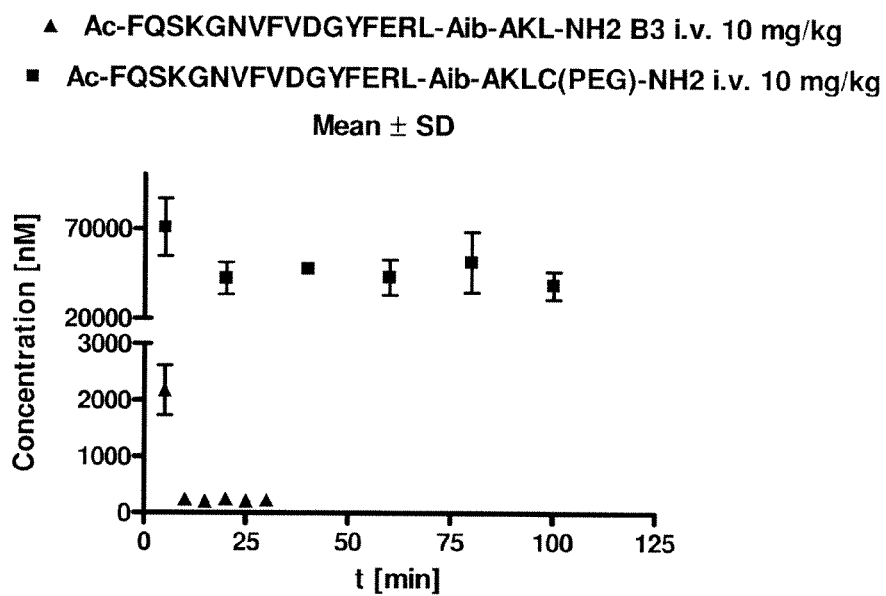
FIG. 31 is a graph comparing a pharmacokinetic characteristic (concentration of peptide (y-axis) versus time after administration (x-axis)) of a PEGylated TFPI-binding peptide to the pharmacokinetic characteristic of same peptide lacking PEG. The peptides were administered intravenously to C57B16 mice at a dose of 10 mg/kg. Three biological samples were analyzed for the presence of peptide at each time point.
Figure 40:
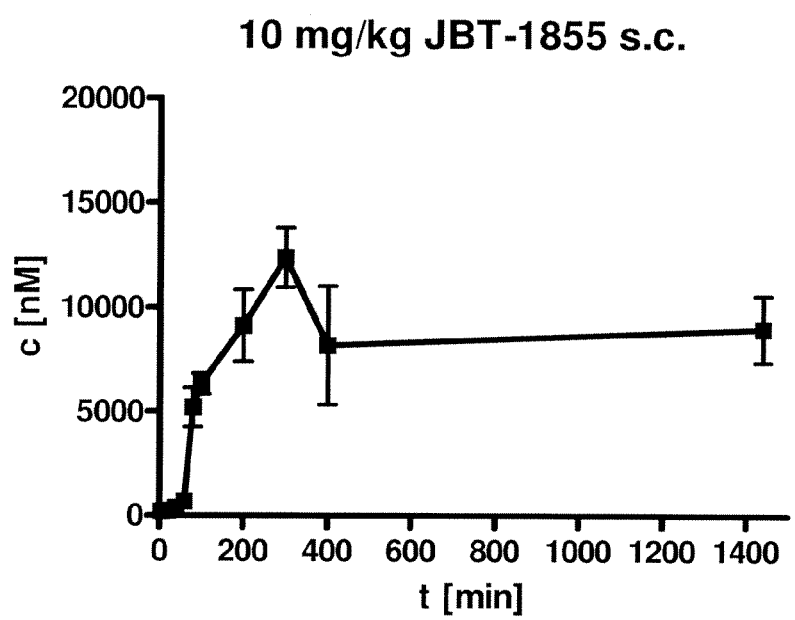
FIG. 40 is a graph illustrating a pharmacokinetic characteristic (concentration of peptide (nM) (y-axis) versus time after administration (minutes) (x-axis)) of a PEGylated TFPI-binding peptide following subcutaneous administration to mice at a dose of 10 mg/kg.
Figure 41:
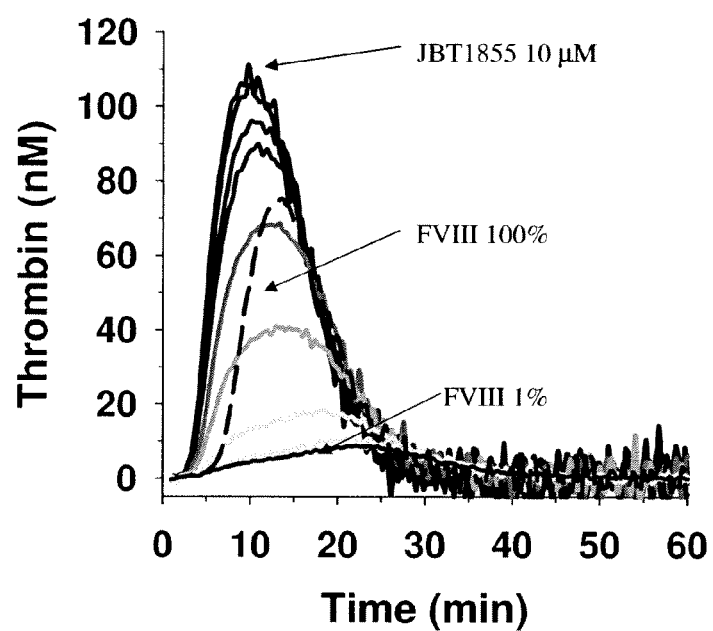
FIG. 41 is a graph correlating the amount of thrombin generated (nM) (y-axis) with time (minutes) (x-axis) for peptide JBT1855 in a plasma-based assay of hemophilia A patient plasma.

The resulting PEGylated peptides demonstrated significantly increased plasma stability and prolonged plasma half-life in mice. FIG. 31 illustrates the results from a pharmacokinetic analysis of the free peptide JBT0740 (Ac-FQSKGNVFVDGYFERL-Aib-AKL-NH2) (SEQ ID NO: 66) compared to the C-terminally PEGylated peptide JBT1855 (Ac-FQSKGNVFVDGYFERL-Aib-AKLC(PEG (40 kD))-NH2) (SEQ ID NO: 252) following intravenous administration to mice. In contrast to the unPEGylated peptide, the PEGylated peptide is present at high concentrations in mouse plasma at 100 minutes post-administration. The unPEGylated peptide is rapidly cleared from the plasma. FIG. 40 illustrates the results from a pharmacokinetic analysis of JBT1855 following subcutaneous injection. JBT1855 also strongly improved thrombin generation in the assay described in Example 4 (FIG. 41).

The JBT1852 and JBT1855 peptides also were characterized in the assays described in Examples 1-4 and compared to JBT0740 and other peptides in the JBT0047 family. Representative results are provided in Table 10 set forth below.

TABLE 10

| | TFPI-1α Affinity (nM) Biacore $K_D$ | FXa Inhibition $IC_{50}$ (µM) | FVIII-equivalent activity (mU/ml) in FVIII deficient plasma @ 1 µM peptide | Solubility (mg/ml; PBS without $Ca^{2+}$ and $Mg^{2+}$) | Plasma Stability (half life in minutes) mouse | human |
|---|---|---|---|---|---|---|
| JBT0717 | 1.1 | 0.05 | 421 | 0.97 | 24 | >120 |
| JBT0740 | 2.4 | 0.06 | 333 | 0.92 | 50 | >120 |
| JBT1584 | 0.3 | 0.02 | 486 | 2.66 | 40 | >120 |
| JBT1852 | 11.1 | 0.17 | >1000 | >1.00* | >120 | >120 |
| JBT1855 | 10.5 | 0.07 | >1000 | >1.00* | >120 | >120 |

*formulated in 25 mm HEPES, pH 7.35, 175 mM NaCl

The peptides listed in Table 10 also were assayed for interaction with the TFPI-2 anti-target, and generated signals too low for reliable affinity measurement. The data suggest that PEGylation does not ablate the inhibitory activity of the inventive peptides or negatively affect selectivity for TFPI-1.

Cell-Based Extrinsic Tenase Assay

The ability of the TFPI-binding peptides described above to restore extrinsic tenase complex-mediated conversion of FX to FXa also was determined using a cell-based extrinsic tenase assay. The cell-based extrinsic tenase assay also was employed to explore the influence of PEGylation on an exemplary TFPI-binding peptide of the invention, JBT0740. Human umbilical vein endothelial cells (HUVEC) were counted and seeded in complete growth medium in a 96-well plate (black flat with clear bottom) at a density of $1.5 \times 10^4$ cells per well. Cells were grown overnight (for approximately 16 to 18 hours), washed twice with pre-warmed basal medium, stimulated with 1 ng/ml recombinant TNFα (Sigma Aldrich (Cat. No. T6674)) in 200 µl of basal medium for four hours at 37° C., and washed twice with 200 µl of pre warmed cell culture buffer. Buffer (50 µl) containing FVIIa (Enzyme Research Laboratories), TFPI-binding peptides (dissolved in either DMSO or Hepes buffered saline with or without 0.1% Tween-80), or αTFPI antibodies were applied to the cells and incubated for 20 minutes at 37° C., allowing FVIIa/TF complex formation and binding of TFPI antagonists to TFPI. After the incubation period, 50 µl of cell culture buffer containing FX and a FXa-specific substrate (Fluophen FXa (HYPHEN BioMed)) was applied, resulting in a final volume of 100 µl cell culture buffer mix on the cells. The final concentrations were: 39 pM FVIIa; 170 nM FX; 250 µM Fluophen FXa, and 2.5% DMSO (when peptides were dissolved in DMSO).

The 96 well plate was transferred to a pre-warmed (37° C.) fluorescence reader for detecting FXa-specific fluorogenic substrate conversion by FXa, which is generated by the TF/FVIIa complex on the surface of stimulated HUVECs. Readings taken after nine minutes of incubation were used for calculation of the TFPI inhibitory effect of the TFPI-binding peptides or antibodies. The approximate percent inhibition of TFPI observed at various concentrations of the following peptides (belonging to the JBT0047 family) is set forth in Table 11: JBT0717 (Ac-FQSK-Nmg-NVFVDGYFERL-RAKL-NH2) (SEQ ID NO: 61), JBT0740 (Ac-FQSKGN-VFVDGYFERL-Aib-AKL-NH2) (SEQ ID NO: 66), JBT1584 (Ac-FQSK-Nmg-NVFVDGYFERL-Aib-AKL-NH2) (SEQ ID NO: 164), and JBT1857 (Ac-FQSKpNVH-VDGYFERL-Aib-AKL-NH2) (SEQ ID NO: 178).

TABLE 11

| | % TFPI inhibition | | | | |
|---|---|---|---|---|---|
| | 40 μM | 8 μM | 1.6 μM | 0.32 μM | 64 nM |
| JBT0717 | 60% | 50% | 32% | 28% | 20% |
| JBT0740 | 70% | 39% | 28% | 14% | 3% |
| JBT1584 | 73% | 62% | 51% | 40% | 29% |
| JBT1857 | 80% | 57% | 41% | 35% | 15% |

PEGylated peptides also were tested using the cell-based extrinsic tenase assay. JBT0740 (SEQ ID NO: 66) was conjugated to a 1 kD PEG moiety at the N-terminus to produce JBT1853 or at the C-terminus to produce JBT1854. JBT1853 and JBT1854 inhibited TFPI by 20% or less depending on the amount of peptide used in the assay. JBT1855, which comprises a 40 kD PEG moiety at the C-terminus (parent peptide, JBT0740) performed better in the cell-based assay than JBT1852, which comprises a 40 kD PEG moiety at the N-terminus. JBT1855 mediated 20-30% TFPI inhibition, while JBT1852 inhibited TFPI activity by 10% or less.

Peptides of the JBT0120 family, JBT0120, JBT0415, JBT0444, JBT1426, and JBT1837, also were tested in the cell-based extrinsic tenase assay and found to inhibit TFPI to a lesser degree compared to peptides of the JBT0047 family. The reduced or partial inhibitory activity may be desired in some embodiments of the invention. Similar to the peptides of the JBT0047 family, peptide optimization increased TFPI inhibitor activity of JBT0120 family peptides.

In the course of examining the stability and inhibitory activity of JBT1857, it was determined that the amino acid sequence of the peptide contained a protease cleavage site between Val9 and Asp10. Substitution of Tle at position 9 (generating JBT2431) and substitution of Pro at position 10 (generating JBT2432) blocked cleavage of the peptide and enhanced the plasma stability of the peptide by about three-fold from 27% (JBT1857) to 82% (JBT2431) and 76% (JBT2432). An additional putative cleavage site was identified between Gly11 and Tyr12. A G11a substitution (generating JBT2414) further improved the stability of the peptide to 100%. All stabilities were determined by quantitative ELISA after 24 hour incubation in human plasma.

The results described above demonstrate that optimization of the TFPI-binding peptides described herein utilizing non-conventional amino acids improved TFPI inhibition and plasma stability. Additionally, PEGylated peptides of the invention inhibit TFPI activity in a cell-based extrinsic tenase assay, with C-terminal PEGylated peptides performing better than N-terminal PEGylated peptides. The TFPI-binding peptides of the invention inhibit the activity of both free TFPI and cell-bound TFPI.

Example 6

The following example illustrates the ability of peptides described herein to reduce bleeding in an animal model.

Figure 42:
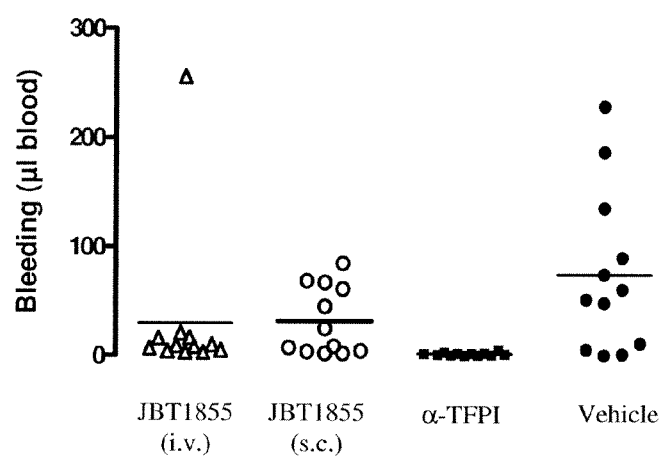
FIG. 42 is a graph illustrating the amount of blood loss (μl; y-axis) observed following a nail-clip in mice treated with JBT-1855 (intravenous or subcutaneous administration), anti-TFPI antibody (intravenous administration), or vehicle (intravenous administration) (x-axis).

Ten week old C57B1/6NCrl mice were housed for two weeks prior to the study. Thirty minutes before the nail clip, the animals were administered (a) JBT1855 (10 mg/kg) intravenously (i.v.) via the tail vein or subcutaneously (s.c.) in the neck region, (b) anti-TFPI antibody (18 mg/kg; i.v.), or (c) vehicle (175 mM NaCl, 25 mM HEPES, pH 7.35; 10 ml/kg; i.v.). The animals were anaesthetized with 80 mg/kg pentobarbital ten minutes prior to the nail clip. To achieve bleeding, the nail of the small toe of the right hind paw was removed. The paw was submerged in a 0.9% NaCl solution for blood collection for a period of 60 minutes. Blood loss was quantified after lysis by spectrophotometry. The temperature was kept constant at 37° C. over the course of the experiment. The results of the study are illustrated in FIG. 42 and summarized in Table 12.

TABLE 12

| | JBT1855 i.v. | JBT1855 s.c. | α-TFPI i.v. | Vehicle i.v. |
|---|---|---|---|---|
| Mean (in μl) | 29.9 | 31.7 | 1.9 | 74.9 |
| (SD) | (71.4) | (31.5) | (1.4) | (74.6) |
| # of mice | 12 | 12 | 12 | 12 |
| p-value | 0.07 | 0.04 | 0.001 | |

Intravenous or subcutaneous administration of JBT1855, a PEGylated peptide of the invention, reduced blood loss in mice compared to treatment with vehicle alone.

Example 7

The following example describes characterization of TFPI-peptide interactions via nuclear magnetic resonance and x-ray crystallography. In particular, the TFPI binding site of the antagonistic peptides JBT0303, JBT0122 and JBT0415; the residues of JBT0303, JBT0122 and JBT0415 interacting with TFPI160; and the secondary structure of complexed and free JBT0303, JBT0122 and JBT0415 were investigated at a molecular level using 2D $^{15}$N-heteronuclear single quantum coherence (HSQC) spectra. The interaction of JBT1857 and KD1 of TFPI was examined using x-ray crystallography, and the residues of TFPI KD1 that mediate JBT1857 binding were mapped.

Identification of the Binding Site of JBT0303 on TFPI160

A $^{15}$N-labelled preparation of TFPI160 was used for titration experiments of TFPI160 with JBT0303. HSQC spectra of a ~500 μM $^{15}$N-TFPI160 sample without and with increasing amounts of peptide were recorded at 30° C. on a Varian 600 MHz spectrometer. The peptide-protein interaction showed slow exchange behavior ($k_{ex} \ll \Delta\omega$), meaning that each TFPI residue results in a defined signal for the free protein and the protein-peptide complex. Unlike fast exchange behavior ($k_{ex} \gg \Delta\omega$), where a mixture results in only one peak with averaged position according to the population of the species, slow exchange behavior does not allow tracking of the signals upon peptide binding. Thus, in order to locate the binding site, the shifted peaks of the TFPI160-JBT0303 complex needed to be assigned. This required the preparation of a sample of $^{13}$C/$^{15}$N-TFPI160 and JBT0303.

Initially, a sample was prepared with 992 μM $^{13}$C/$^{15}$N-TFPI160 and 1190 μM JBT0303. However, the NMR sample resulted in poor quality spectra which did not allow assignment of the complex. The sample gelled, likely due to the formation of high molecular weight aggregates. Thus, the acquired NMR data predominantly showed signals arising from the most flexible parts of the isotope-labeled TFPI160. Therefore, sample conditions were reinvestigated for further experiments. From a series of $^{15}$N-HSQC experiments conducted on the TFPI160-JBT0303 complex, it was concluded that gel formation could be avoided by sample dilution and data acquisition at elevated temperature. The final concentration of $^{13}$C/$^{15}$N-TFPI160 was 331 µM and that of JBT0303 was 397 µM. Spectra quality was improved. Due to the lower concentration and reduced signal-to-noise ratio, assignment had to be performed based on HNCA, HNCO and HNCOCA experiments.

Except for four previously assigned residues, all residues that could be assigned in the apo-TFPI160 could be assigned in the TFPI160-JBT0303 complex. Assignment of some residues was ambiguous due to the lack of peaks in the 3D spectra. Furthermore, the peaks of three residues were only visible in the HSQC spectrum from the original titration experiment. However, all peaks in the vicinity where unambiguously assigned and, therefore, the assignment of these residues is likely to be correct.

Figure 43:
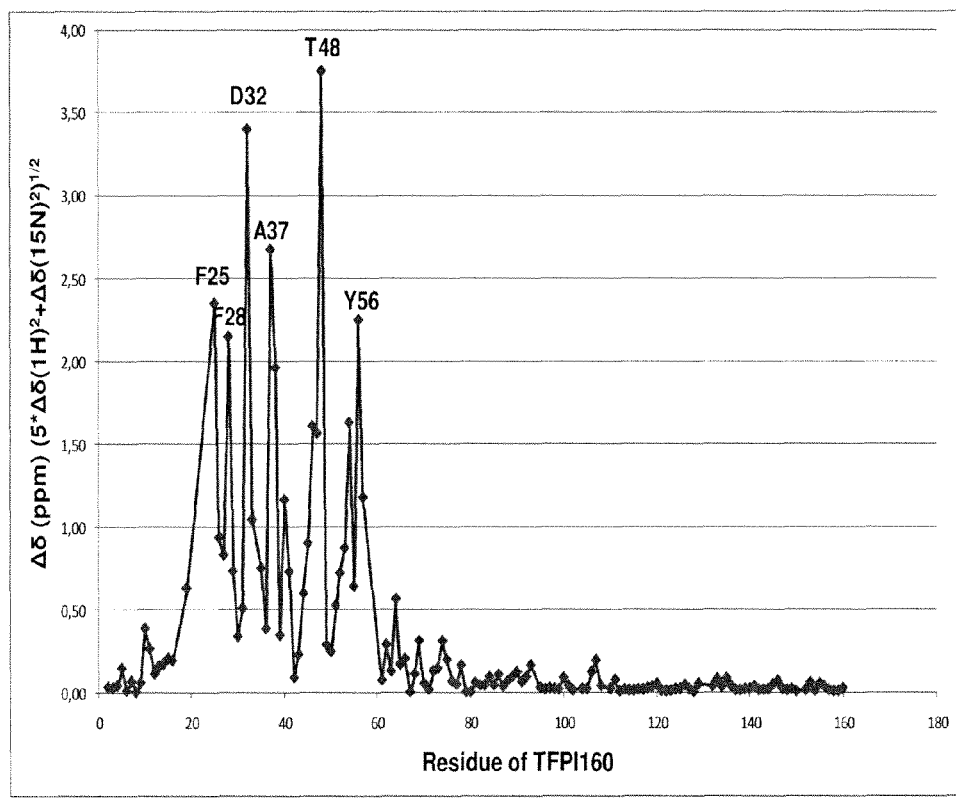
FIG. 43 is a graph plotting TFPI160 amino acid residue (x-axis) against the chemical shift differences of HSQC signals for free TFPI160 and TFPI160 bound to JBT0303 (y-axis).
Figure 44:
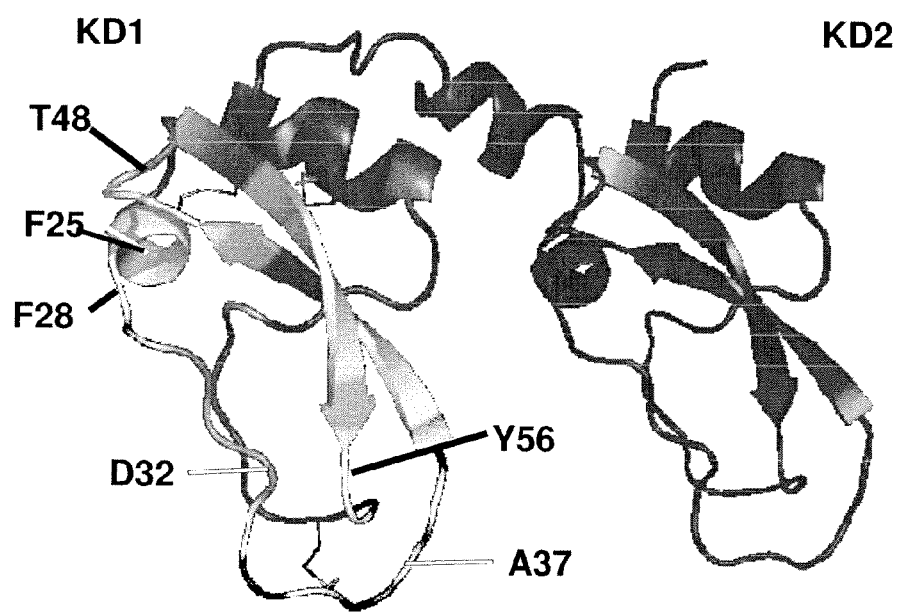
FIG. 44 is a ribbon model of the secondary structure of TFPI illustrating regions of chemical shift changes of HSQC signals when TFPI160 is complexed to JBT0303 compared to uncomplexed (free) TFPI160.

Chemical shift changes of the HSQC signals of $^{15}$N-TFPI160 bound to JBT0303 compared to free TFPI160 is illustrated in FIG. 43. Residues undergoing the strongest chemical shift were exclusively on Kunitz domain 1. Chemical shifts of residues F25, F28, D32, A37, T48 and Y56 shifted the most (>2 ppm). Residues I38, I46, F47 and F54 also shifted more than 1.5 ppm. It is unclear whether residues N-terminal of F25 are involved the interaction with JBT0303 because residues 20-24 are not assigned. L19 shows a change of chemical shift amounting to ~0.6 ppm. Thus, in contrast to previous beliefs that amino acids within residues 1-18 of TFPI are involved in peptide binding, the present data suggest that there is little, if any, peptide binding to the N-terminal tail of TFPI. A ribbon model of the secondary structure of TFPI protein illustrating regions of chemical shift changes of HSQC signals of TFPI160 bound to JBT0303 compared to free TFPI160 is set forth in FIG. 44.

To more particularly identify the binding site of JBT0303 on TFPI160, the amide exchange rates of $^{15}$N-TFPI160 and $^{15}$N-TFPI160+JBT0303 were determined. The amide exchange experiment mainly detects changes in the environment of the peptide backbone by measuring H exchange of amide groups. The H$_2$O frequency is irradiated with a power high enough that it is not dissipated by relaxation, resulting in a complete saturation and suppression of the H$_2$O signal. A side effect of this method of H$_2$O signal suppression is that the suppression is transferred to exchangeable amide NHs which exchange with solvent (H/H exchange). The saturation transfer is dependent on the H/H exchange rate which is semi-quantitative. The effect is reduced for more protected NH groups (i.e., unprotected NHs are attenuated more than protected NHs). If a protected NH lies in proximity to H-alphas of a ligand, a higher exchange rate is observed compared to the apo form. Similarly, H exchanges can be mediated by the OH groups of Ser, Thr or Tyr.

HSQC spectra without and with water suppression of apo $^{15}$N-TFPI160 and the $^{15}$N-TFPI160-JBT0303 complex were recorded. The relative exchange rate of each residue of TFPI160 was determined by calculating the ratio of the peak intensities in the HSQC spectra with and without water suppression. A comparison of the data sets of $^{15}$N-TFPI160 and $^{15}$N-TFPI160+JBT0303 revealed that TFPI residues 25, 26, 36, 62, 63, 127, 132 and 152 exhibited greater than 10% decreased amide exchange rate in the complex, whereas residues 29, 30, 42, 45, 49, 50, 56, 66 and 98 exhibited more than 10% increased exchange rate.

Constraints derived from the amide exchange experiment were included for the calculation of refined HADDOCK models: (a) torsion angles are taken from the calculations of TALOS for K4, K5, V7, F8, Y12-A18 of JBT0303 (chemical shift experiments); (b) residues of KD1 with chemical shift changes of more than 1.5 ppm are involved in binding JBT0303: F25, F28, D32, A37, I38, I46, F47, T48, F54 and Y56 (chemical shift experiments); (c) the hydrophobic side of the amphipathic helix of JBT0303 is bound to KD1: Y12 or L16 or L20 of JBT0303 bind to D32 or A37 or I38 or F54 or Y56 of KD1 (chemical shift experiments); (d) R15 or K19 of JBT0303 bind to D31 or D32 or E60 of KD1 (chemical shift experiments); (e) F8 or V9 of JBT0303 bind to F25 or F28 of KD1 (chemical shift experiments); (f) Y12 or F13 of JBT0303 bind to I46 or F47 or T48 of KD1 (chemical shift experiments); (g) Q2 of JBT0303 binds to Y56 of KD1 (chemical shift experiments); (h) F1 of JBT0303 binds to M39 or F66 of KD1 (amide exchange experiments); (i) S3 or K4 or K5 of JBT0303 bind to F66 (amide exchange experiments); (j) V7 or F8 or V9 of JBT0303 bind to F25 or C26 or N62 or Q63 of KD1 (amide exchange experiments); (k) V9 or D10 or G11 or R15 of JBT0303 bind to F28 or K29 or A30 of KD1 (amide exchange experiments); (l) Y12 or F13 of JBT0303 bind to N45 of KD1 (amide exchange experiments); (m) Y12 or F13 or E14 or R15 bind to R49 or Q50 of KD1 (amide exchange experiments); and (n) L20 of JBT0303 binds to K36 of KD1 (amide exchange experiments). The data converged to essentially one model of the KD1+JBT0303 complex.

Identification of the Binding Site of JBT0122 on TFPI160

As with the $^{13}$C/$^{15}$N-TFPI160+JBT0303 complex, the $^{13}$C/$^{15}$N-TFPI160+JBT0122 NMR sample resulted in spectra of poor quality due to the formation of a gel. The concentration of 723 µM $^{13}$C/$^{15}$N-TFPI160+JBT0122 lead to formation of higher order aggregates. The sample was diluted to 361.5 µM and spectra recorded at 37° C., resulting in improved spectra quality. HNCO, HNCA and HNCOCA spectra were acquired. Except for five residues, all of the previously assigned peaks of apo-TFPI160 could be assigned in the TFPI160-JBT0122 complex. Residues undergoing the strongest chemical shift changes and likely to interact with the peptide often did not result in peaks in the 3D spectra. Peaks in the linker region between Kunitz domain 1 (KD1) and Kunitz domain 2 (KD2), however, also exhibited low intensities. Hence, the assignment of these peaks is ambiguous. Some peaks were only visible in the HSQC of the original titration experiment. Their assignment was in most cases certain, as the peaks overlapped in the TFPI160 and the TFPI160+JBT0122 HSCQ spectra.

Figure 45:
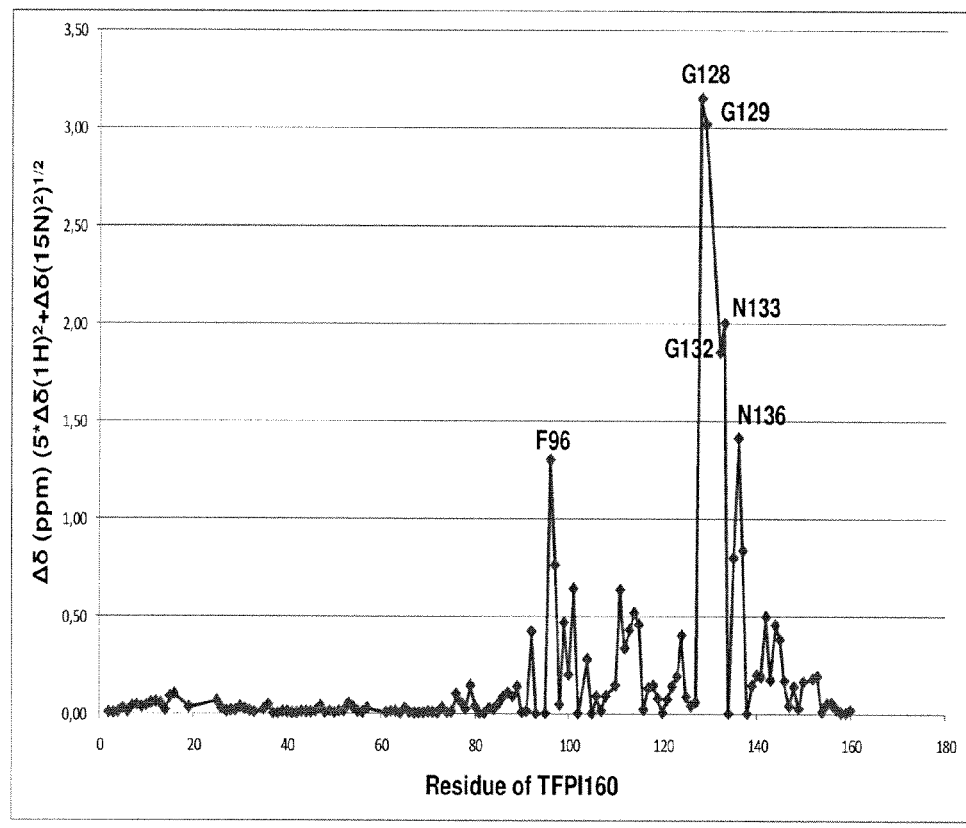
FIG. 45 is a graph plotting TFPI160 amino acid residue (x-axis) against the chemical shift differences of HSQC signals for free TFPI160 and TFPI160 bound to JBT0122 (y-axis).
Figure 46:
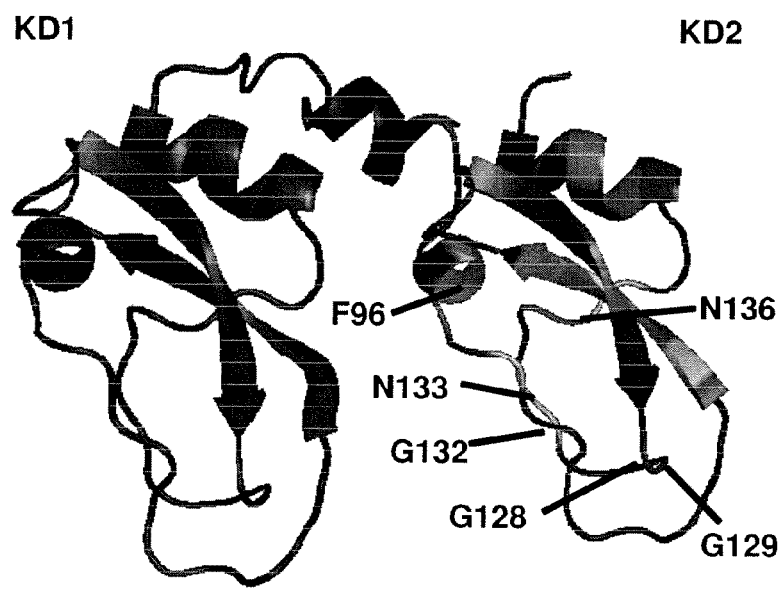
FIG. 46 is a ribbon model of the secondary structure of TFPI protein illustrating regions of chemical shift changes of HSQC signals when TFPI160 is complexed to JBT0122 compared to uncomplexed (free) TFPI160.

Chemical shift changes of the HSQC signals of $^{15}$N-TFPI160 bound to JBT0122 compared to free TFPI160 is illustrated in FIG. 45. Significant chemical shift changes were exclusively found for residues of KD2. In general, the extent of the chemical shift changes caused by binding of JBT0122 to TFPI160 was less pronounced than that of JBT0303. Residues with the strongest perturbation of chemical shift were F96, G128, G129, G132, N133 and N136. C97, E101, T111, F114, N135 and F137 were perturbed, exhibiting chemical shift changes of more than 0.5 ppm. A ribbon model of the secondary structure of TFPI protein illustrating regions of chemical shift changes of HSQC signals of TFPI160 bound to JBT0122 compared to free TFPI160 is set forth in FIG. 46.

Identification Residues of JBT0122 that Interact with TFPI160

For the sequential backbone signal assignment of JBT0122, $^{13}C/^{15}N$-labelled peptide was produced recombinantly. Briefly, the peptide was expressed as a fusion protein with thioredoxin in *E. coli.* $^{13}C/^{15}N$-labelled peptide was prepared using M9 medium containing 3.0 g/l $^{13}C$-glucose and 1.0 g/l $^{15}NH_4Cl$. The fusion protein was affinity purified using a Ni-chelating column and a poly-histidine tag. The peptide was cleaved by thrombin. The thioredoxin/his-tag and thrombin was removed using a Ni-chelating column and a benzamidine column, respectively. The peptide was then purified by reverse phase chromatography. Purity, integrity, and identity were verified by SDS-PAGE, RP-HPLC and mass spectrometry. Recombinant JBT0122 was named JBT0788 and had two additional residues at its N-terminus, glycine and serine, which represent the remains of the thrombin cleavage site.

The assignment of JBT0788 was done on the basis of HSQC, HNCACB, HNCA, HNCO and HNN spectra recorded at 10° C. on a Varian 600 MHz spectrometer and assigned using the SPARKY software. The temperature was reduced compared to NMR experiments with TFPI160 to improve spectra quality. From the recorded spectra, the carbonyl carbon (C), the alpha carbon (CA), the beta carbon (CB), the amide proton (H), and the amide nitrogen (N) of most residues were assigned. The assignment for residues H13 and R17 was ambiguous. An HNCOCA led to an unambiguous assignment for these residues.

An assignment table for JBT0788 is provided in FIG. 47. Two sets of signals for residues 4-12 were observed in the spectra of JBT0788. Considering that the primary structure of JBT0788 is not compromised, the two sets of signals likely result from a cis/trans isomerization of the peptide bond between F6 and P7. A ratio of 76:24 was determined for major:minor conformation based on the intensities of the corresponding signals in the HSQC spectrum. As judged from the Cα shift of the proline, the major conformation is likely trans, as its Cα value of 63.16 ppm is higher than of the minor conformation (62.49 ppm).

One purpose of the assignment was to extract the secondary structure of the peptide from Cα chemical shifts. Cα chemical shifts are influenced by the angles φ and ψ and, thus, by the secondary structure of the peptide. In β-strands, Cα are generally shifted to lower ppm; in α-helices, Cα are generally shifted to higher ppm. By subtracting the measured Cα value from a tabulated random coil value, negative values are calculated for residues in β-strands and positive values for residues in α-helices. Thus, a batch of consecutive negative values indicates a α-strand while a batch of consecutive positive values indicates an α-helix.

Figure 48:
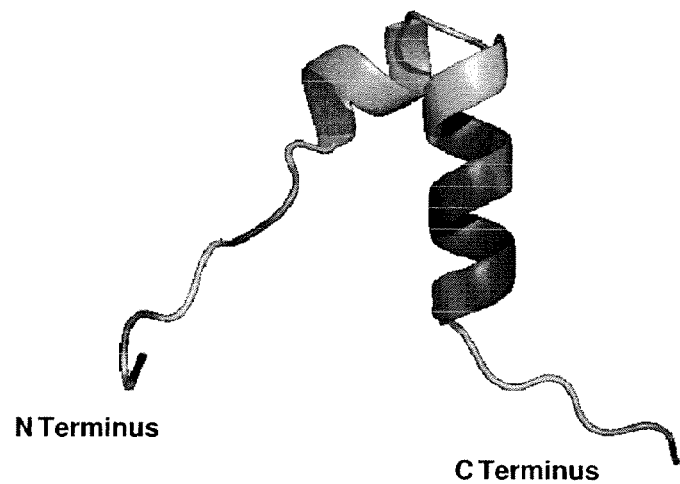
FIG. 48 is a ribbon model of the secondary structure of free JBT0788.

JBT0788 exhibited a broad patch of increased Cα values ($\Delta\delta(C\alpha)=C\alpha_{measured}-C\alpha_{random\ coil}$) indicating an α-helix comprising residues 8 to 26. $\Delta\delta(C\alpha)$ values for stable α-helices within tertiary structures of native proteins are typically between 3-4 ppm. $\Delta\delta(C\alpha)$ values of the α-helix of JBT0788 rise up to about 1.7 ppm, indicating more flexibility than an average helix within a protein. Another feature of JBT0788 is the proline at position 7, directly N-terminal to the α-helix, which fits well as α-helices in proteins are frequently terminated by a proline at the N-terminus. Residue 6 has a strong negative value, which is caused by the neighboring proline known to force its N-terminal neighbor into a β-strand-like conformation. The strong positive value of C-terminal residue 31 is also typical for residues without a C-terminal neighbor. The peptide bond between F6 and P7 in JBT0788 adopts two conformations, a trans (76%) and a cis conformation (24%). The conformation at this position impacts the conformation of the consecutive residues. In the trans isoform, the α-helix starts immediately after P7; the α-helix of the cis isoform does not start until residue L12. A ribbon model illustrating the secondary structure of free JBT0788 is set forth in FIG. 48.

The chemical shifts within JBT0788 can also be employed to calculate the torsion angles using TALOS software. TALOS is a database system for empirical prediction of φ and ψ backbone torsion angles using a combination of five kinds (HA, CA, CB, CO, N) of chemical shift assignments for a given protein or peptide sequence. The TALOS approach is an extension of the observation that many kinds of secondary chemical shifts (i.e., differences between chemical shifts and their corresponding random coil values) are correlated with aspects of protein secondary structure. The goal of TALOS is to use secondary shift and sequence information in order to make quantitative predictions for the protein backbone angles φ and ψ, and to provide a measure of the uncertainties in these predictions. TALOS uses the secondary shifts of a given residue to predict φ and ψ angles for that residue. TALOS also includes the information from the next and previous residues when making predictions for a given residue. The idea behind TALOS is that if one can find a triplet of residues in a protein of known structure with similar secondary shifts and sequence to a triplet in a target protein, then the φ and ψ angles in the known structure will be useful predictors for the angles in the target. In practice, TALOS searches a database for the 10 best matches to a given triplet in the target protein.

In order to assign the HSQC spectrum of JBT0788 complexed with TFPI160, a sample consisting of 400 μM $^{13}C/^{15}N$-JBT0788 and 400 μM TFPI160 was prepared. As with previous NMR samples of peptide and TFPI160, the sample gelled. The sample was diluted and the pellet dissolved in deuterated DMSO, resulting in a final concentration of ~300 μM $^{13}C/^{15}N$-JBT0788+TFPI160 and 5% DMSO. Measurements were performed at 40° C. This improved the quality of the acquired spectra. Experiments were acquired in the TROSY mode to account for the relaxation properties of a partially aggregated sample. Cryo-probe technology on the Varian 600 MHz spectrometer was employed due to the low concentration of the protein-peptide complex in the sample. The resulting data quality was sufficient to obtain the backbone shifts of JBT0788 when utilizing the cryo-probe technology and acquiring the triple-resonance experiments in duplicate. The assignment of JBT0788 in complex with TFPI160 was performed on the basis of HNCA, HNCOCA and HNCO spectra. From the recorded spectra, the carbonyl carbon (CO), the alpha carbon (CA), the amide proton (H), and the amide nitrogen (N) of most residues were assigned. An assignment table for JBT0788 complexed to TFPI160 is provided in FIG. 49.

Figure 50:
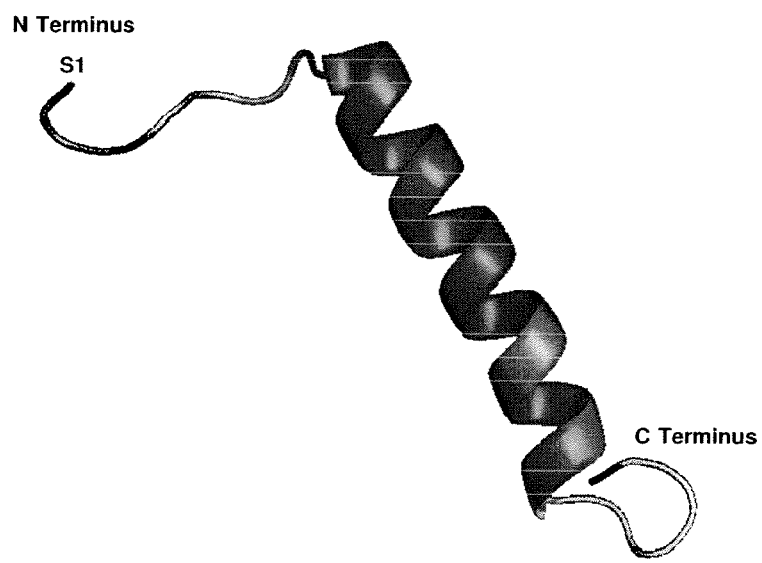
FIG. 50 is a ribbon model of the secondary structure of JBT0788 when complexed with TFPI160.

A feature of apo-JBT0788 was the presence of two sets of signals for amino acid residues 4-12, likely resulting from a cis/trans isomerization of the peptide bond between F6 and P7. In the JBT0788-TFPI160 complex, only one set of peaks is observed, implying that only one of the conformations binds to TFPI160. Apo-JBT0788 also exhibited a broad patch of increased Cα values ($\Delta\delta(C\alpha)=C\alpha_{measured}-C\alpha_{random\ coil}$=positive) indicating an α-helix reaching from residue 8 to residue 26. As mentioned above, $\Delta\delta(C\alpha)$ values for stable α-helices within tertiary structures of native proteins are typically between 3-4 ppm. $\Delta\delta(C\alpha)$ values of the α-helix of apo-JBT0788 increase to about 1.7 ppm, indicating more flexibility than an average helix within a protein. When complexed with TFPI, residues 8 to 26 exhibited values of between 3-5 ppm, indicating the formation of a stable α-helix or helices. A ribbon model illustrating the secondary structure of JBT0788 when complexed with TFPI160 is set forth in FIG. 50. Large chemical shift changes within JBT0788 caused by binding with TFPI160 are evenly distributed over the length of the peptide. Residues undergoing the strongest perturbation of chemical shift were residues S5, A9, Q11, Y28, and K29 with more than 4 ppm. Residues Y3, A4, V10, L12, S15, M21, A22, L23, and A24 were perturbed by more than 3 ppm.

Identification of Residues of JBT0303 that Interact with TFPI160

JBT0303 was produced recombinantly using the same procedure as described above for JBT0122 and isotope-labeled with $^{13}C$ and $^{15}N$. The recombinant JBT0303 was named JBT0616 and had an additional glycine and serine at its N-terminus. The assignment of JBT0616 was performed on the basis of HSQC, HNCACB and HNN spectra, which were recorded at 10° C. on a Varian 500 MHz spectrometer and assigned using SPARKY software. The quality of the spectra of JBT0616 was better than that of JBT0788, although the experimental conditions with respect to buffer, temperature, NMR tube, and NMR parameters were identical. The alpha carbon (CA), the beta carbon (CB), the amide proton (H), and the amide nitrogen (N) of most residues were assigned. The assignment was mainly based on the less sensitive but more informative HNCACB instead of the HNCA. In combination with the HNN spectrum, this resulted in an unambiguous assignment of all JBT0303 derived residues.

Figure 52:
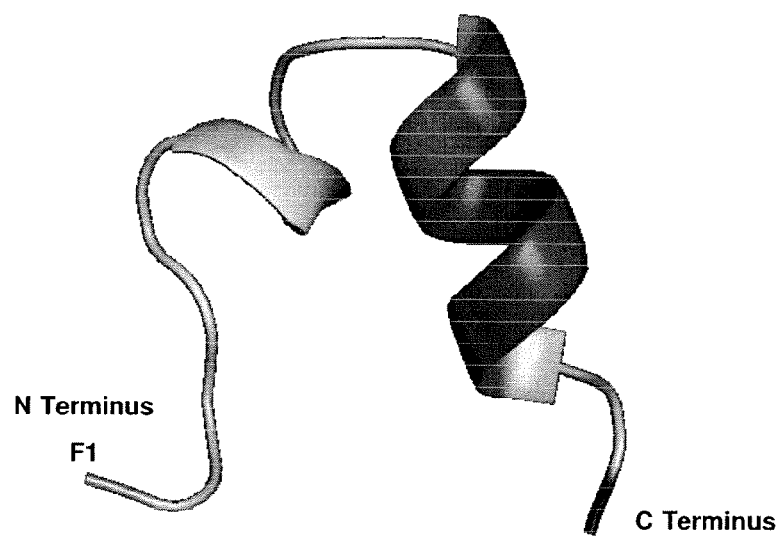
FIG. 52 is a ribbon model of the secondary structure of free JBT0616.

An assignment table for JBT0616 is provided in FIG. 51. The secondary structure was extracted from Cα chemical shifts and determined by TALOS using the assignments of H, CA, CB, CO and N. Like JBT0788, JBT0616 exhibited a patch of positive $\Delta\delta(C\alpha)$ values indicative of α-helical conformation. The helix was located at the C-terminal part of the peptide and comprised residues 10-18. As for JBT0788, $\Delta\delta(C\alpha)$ values up to about 1.8 ppm were calculated, qualifying this helix as relatively stable for such a short peptide. A ribbon model illustrating the secondary structure of JBT0616 is set forth in FIG. 52. The strong positive value of the C-terminal residue 20 is, like residue 31 in JBT0788, typical for residues without a C-terminal neighbor. The N-terminal residues 1-9 of JBT0616 exhibited slightly positive $\Delta\gamma(C\alpha)$ values, suggesting a preference for an α-helical structure.

Figure 54:
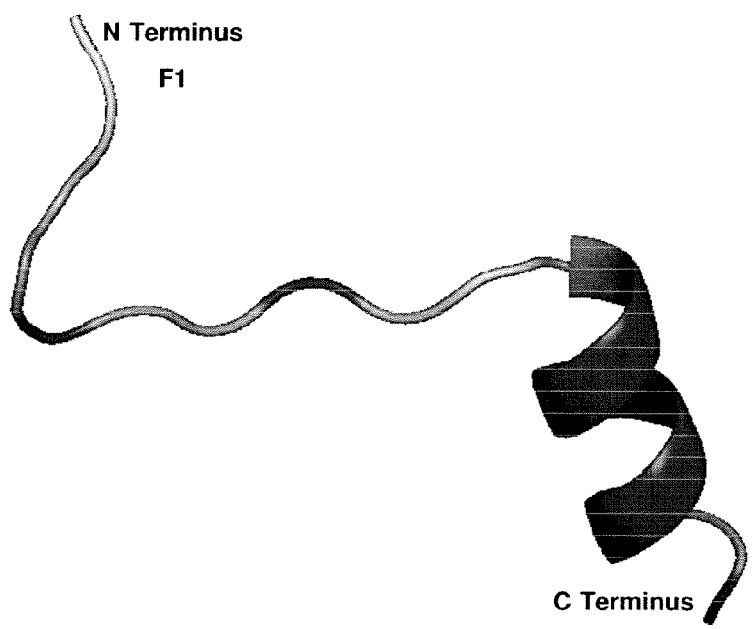
FIG. 54 is a ribbon model of the secondary structure of JBT0616 when complexed with TFPI160.
Figure 55:
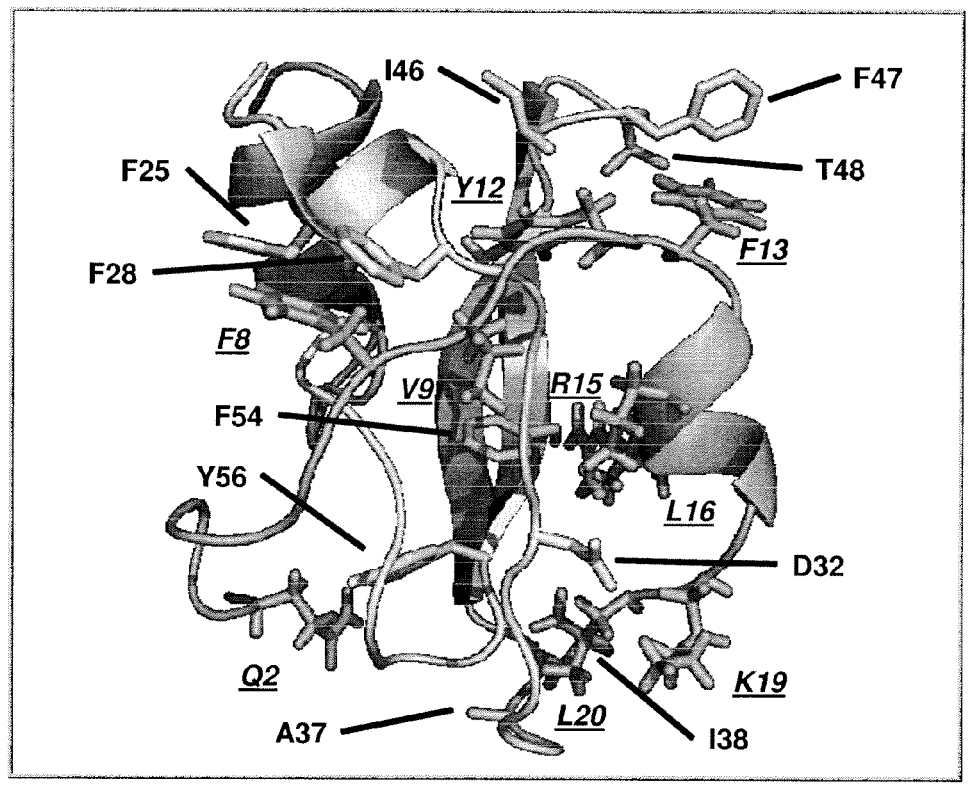
FIG. 55 is a ribbon structure of the energetically minimized best model of KD1 (residues 22-79) in complex with JBT0303 with residues proposed to drive the protein-protein interaction displayed as sticks. Italicized and underlined residues belong to JBT0303; the remaining residues belong to KD1 of TFPI.

The assignment of JBT0616 in complex with TFPI160 was performed using a $^{13}C/^{15}N$-labelled peptide sample with an excess of unlabelled TFPI160. HSQC, HNCA, HNCOCA, and HNCO spectra were recorded on a Varian 800 MHz spectrometer and assigned using the SPARKY software. The spectra were recorded at 30° C. Using these spectra, the alpha carbon (CA), the beta carbon (CO), the amide proton (H), and the amide nitrogen (N) of most residues were assigned, as set forth in the table in FIG. 53. The secondary structure of JBT0616 in complex with TFPI160 was extracted from Cα chemical shifts and calculated by TALOS Like the free peptide, JBT0616 in complex with TFPI160 exhibited a C-terminal patch of positive $\Delta\delta(C\alpha)$ values indicative of α-helical conformation. The stability of the α-helix is increased upon complex formation. This finding suggests that the C-terminal region of JBT0616 is the core binding motif. The $\Delta\delta(C\alpha)$ values for the N-terminal residues also changed, but to a lesser extent. The secondary structure of JBT0616 when complexed with TFPI is illustrated in the ribbon model in FIG. 54.

The most significant changes of chemical shifts upon complex formation were observed for residues Q2, K5, F8, V9 and A18 of JBT0616 with more than 7 ppm. Residues F13, R17, K19 and L20 also were perturbed and demonstrated chemical shift changes of more than 4 ppm. The strong chemical shift changes of residues at the N-terminus indicated that it is not only the amphipathic C-terminal α-helix which drives binding of the peptide to TFPI160.

Results from the NMR experiments in combination with analysis of JBT0477 substitutions were used to create a model of KD1 in complex with JBT0303 using HADDOCK (High Ambiguity Driven protein-protein DOCKing) software. HADDOCK is an information-driven flexible docking approach for the modeling of biomolecular complexes. HADDOCK distinguishes itself from ab-initio docking methods in the fact that it encodes information from identified or predicted protein interfaces in ambiguous interaction restraints (AIRs) to drive the docking process. Identification of the binding site on TFPI160 and the peptides as revealed by chemical shift data, the torsion angles of the peptides as determined by the software TALOS, and the substitution analysis of JBT0477 provide the restraints for the calculation of the models.

For the calculation of the KD1-JBT0303 HADDOCK models, the following restraints were employed: (a) torsion angles were taken from the calculations of TALOS for K4, K5, V7, F8, Y12-A18 of JBT0303; (b) residues of KD1 with chemical shift changes of more than 1.5 ppm are involved in binding to JBT0303: F25, F28, D32, A37, I38, I46, F47, T48, F54 and Y56; (c) the hydrophobic side of the amphipathic helix of JBT0303 is bound to KD1: Y12 or L16 or L20 of JBT0303 bind to D32 or A37 or I38 or F54 or Y56 of KD1; (d) R15 or K19 of JBT0303 binds to D31 or D32 or E60 of KD1; (e) F8 or V9 of JBT0303 binds to F25 or F28 of KD1; (f) Y12 or F13 of JBT0303 binds to I46 or F47 or T48 of KD1; and (g) Q2 of JBT0303 binds to Y56 of KD1. The Q2 JBT0303-Y56 KD1 interaction also was taken as a restraint for model calculation.

Strong chemical shift changes were observed for K5 of JBT0303 upon complex formation. For the remaining residues of JBT0303 considered to drive the peptide-protein interaction, the models are in good agreement with the data. The model of KD1-JBT0303 with the lowest energy places F8 of JBT0303 in proximity to F25 and F28 of TFPI, explaining the observed chemical shift changes and the data from the substitution analysis. V9 of JBT0303 interacts with the hydrophobic patch of the KD1 including F54. Y12, F13, L16 and L20 of JBT0303 also face the hydrophobic patch of the KD1. The proximity of Y12 to F28, I46, T48 of F13 to F47, T48, of L16 to F54 and of L20 to A37, I38 causes the observed perturbations of NMR chemical shift of those residues in the complex; the conservation of Y12 and L16 may be due to the extensive interactions of these residues with the protein. K19 of JBT0303 is in a position allowing interaction with D32 of KD1. The role of R15 of JBT0303 seems to be an interaction with the hydrophobic patch of KD1 as well as with D32. Moreover, the model explains why a negatively charged aspartate is preferred at position 10 of JBT0303; it can interact with the positively charged K29 of KD1. A glycine at position 11 of JBT0303 is present due to the steric and conformational restraints at this position. A HADDOCK model of KD1 (TFPI residues 22-79 comprising KD1) in complex with JBT0303 is provided in FIG. 55.

Models of JBT0740 and JBT1857 Bound to KD1

Peptides JBT0740 and JBT1857 (FQSK-dP-NBHBDGY-FERL-Aib-AKL (SEQ ID NO: 178)), both derivatives of JBT0303, demonstrate significantly enhanced $EC_{50}$ values in the FXa-TFPI inhibition assay (0.11 μM and 0.0023 μM, respectively) and lower $K_d$'s as determined by Biacore. Models of JBT0740 and JBT1857 in complex with TFPI KD1 (residues 22-79 of TFPI160) were calculated by HADDOCK using similar constraints as for JBT0303: (a) the constraints for the torsion angles of residues 4 and 5 of JBT0740 and JBT1857 were amended in order to take account of the substitutions at position 5 of the JBT0303 derivatives; (b) torsion angles were taken from the calculations of TALOS for V7, F8, Y12-A18 of JBT0303 and, in contrast to JBT0303, no fixed values for Phi and Psi were given for K4 and for NmetGS/dPS; (c) NmetG5 and dP5 are in the cis conformation; (d) residues of KD1 with chemical shift changes of more than 1.5 ppm are involved in binding to JBT0303: F25, F28, D32, A37, I38, I46, F47, T48, F54 and Y56; (e) the hydrophobic side of the amphipathic helix of JBT0303 is bound to KD1; (f) Y12 or L16 or L20 of JBT0303 bind to D32 or A37 or I38 or F54 or Y56 of KD1; (g) residues R15 or K19 of JBT0303 bind to D31 or D32 or E60 of KD1; (h) residues F8 or V9 of JBT0303 bind to F25 or F28 of KD1; (i) residues Y12 or F13 of JBT0303 bind to I46 or F47 or T48 of KD1; and (j) residue Q2 of JBT0303 binds to Y56 of KD1.

The energetically most favorable HADDOCK models of JBT0740 and JBT1857 illustrated a different mode of binding compared to JBT0303. The most obvious differences were in the region of residues 5 to 11. Less dramatic deviations were observed at the N-terminus and the C-terminus of the peptides. However, the different binding of the termini also might contribute to the optimized binding of the JBT0303 derivatives to TFPI.

X-Ray Crystal Structure of JBT1857 Bound to KD1

The crystal structure of KD1 in complex with a KD1 binding peptide, JBT1857, was determined. TFPI was recombinantly expressed in *E. coli* and oxidatively refolded from inclusion bodies. TFPI amino acids 1-150 comprising a thrombin cleavage site within the TFPI linker sequence joining KD1 and KD2 (TFPI1-150-Thrombin (MADSEEDEEHTIITDTELPPLKLMHSFCAFKADDGPC-KAIMKRFFFNIFTRQCEEFI YGGCEGNQNRFESLEECKKMCTRDNANR-LVPRGSQQEKPDFCFLEEDPGICRGYI TRYFYNNQT-KQCERFKYGGCLGNMNNFETLEECKNICEDG (SEQ ID NO: 4235)) was cloned into an *E. coli* expression vector (pET19b). The TFPI 1-150-Thrombin sequence comprises two amino acids at the N-terminus that are artifacts of recombinant expression, and are not part of the wild-type TFPI amino acid sequence. The sequences encoding Kunitz domain 1 and 2 are bolded. *E. coli* (BL21(DE3) pLysS) was cultivated in MagicMedia™ and TFPI 1-150-Thrombin was expressed as insoluble inclusion bodies. Inclusion bodies were harvested by lysis of *E. coli* by incubation with Bug-Buster Master Mix and purified upon washing with 50 mM Tris/HCl pH 8, 0.1% Tween 20. Inclusion bodies were dissolved in 8M urea, 50 mM Tris/HCl pH 8.0 and TFPI 1-150-Thrombin was reduced upon addition of 20 mM DTT. Oxidative refolding was performed by rapid 1/10 dilution into a buffer containing 50 mM Tris/HCl pH 10 and 1.1 mM oxidized Glutathion, followed by excessive dialysis against 20 mM Tris/HCl pH 7. Refolded TFPI1-150-Thrombin was purified by a sequential purification protocol using a Q Sepharose FF anion exchange and a peptide affinity (JBT131) media. Purified TFPI1-150-TFPI was proteolytically digested by incubation with thrombin (1 U thrombin/mg TFPI1-150-Thrombin, cleavage site, LVPR/GS) resulting in the generation of Nterm KD1-Thrombin (MADSEEDEEHTIITDTELPPLKLMHSFCAFKADDGPCKAIMKRFFF-NIFTRQCEEFI GGCEGNQNRFESLEECKKMCTRD-NANRLVPR (SEQ ID NO: 4236)) and KD2-Thrombin (GSQQEKPDFCFLEEDPGICRGYITRY-FYNNQTKQCERFKYGGCLGNMNNFETLE ECK-NICEDG (SEQ ID NO: 4237)). Nterm KD1-Thrombin was purified from the digestion mixture using benzamidin sepharose for removal of thrombin, followed by a JBT131 peptide affinity column. Purified Nterm KD1-Thrombin was used for complex formation with JBT1857 and further crystallization.

The antagonistic peptide, JBT1857, was prepared by solid phase synthesis. Successful co-crystallization of equimolar complexes was obtained under 100 mM MES pH 6.5, 20% PEG 4000, 600 mM NaCl. Crystals diffracted to better than 2.5 Å resolution, albeit with some non-merohedral twinning. Diffraction data were processed with iMosflm and SCALA from the CCP4 program package, revealing a monoclinic crystal form with unit cells dimensions of a=113.67 Å, b=69.32 Å, c=42.37 Å, α=90.0°, β=92.97°, γ=90.0°, spacegroup C2 (Leslie, *Acta Crystallogr D Biol Crystallogr*, 62(Pt 1), 48-57 (2006); Evans, Acta Crystallogr D Biol Crystallogr, 62(Pt 1), 72-82 (2006)). Self-rotation calculations indicated an approximately two-fold non-crystallographic symmetry. Consistent herewith, two molecules were localized in the asymmetric unit related by a 170° rotation. The Patterson search was carried out by using the program PHASER and a structure ensemble of the available Kunitz domain 2 crystal structures as search model (McCoy et al., *J Appl Crystallogr*, 40(Pt 4), 658-674 (2007)). The unit cell contained approximately 64% solvent. Non-crystallographic electron density averaging and model building and model refinement was carried out with Coot, Refmac, MAIN and CNS programs. The current model was completely defined for both copies of the JBT1857 peptide and the interaction with the protein with current R=0.257, Rfree=0.298, deviation from ideal geometry rms(bond)=0.008 Å, rms(angle)=1.8°.

JBT1857 Structure:

The structure of JBT1857 can be segmented into (i) the N-terminal anchor consisting of acetylated $Phe1_{AP}$-$Gln2_{AP}$; (ii) an Ω-shaped loop comprising $Ser3_{AP}$-$Asn6_{AP}$; (iii) an intermediate segment built from $Val7_{AP}$ and $His8_{AP}$; (iv) a tight glycine-loop containing $Val9_{AP}$-$Gly11_{AP}$; and (v) the C-terminal α-helix comprising $Tyr12_{AP}$-$Leu20_{AP}$. As used herein, the subscript $_{AP}$ indicates the sequence numbering in the "antagonistic peptide" JBT1857. The conformation of the α-helix is stabilized by a non-natural α-methyl alanine positioned at the center of the helix (position $17_{AP}$); a C-terminal amide that completes the 1-4 hydrogen bonding pattern of the α-helix; and a stacked cluster by the aromatic side chains of $His8_{AP}$, $Tyr12_{AP}$ and $Phe13_{AP}$. These effects cooperate to stabilize the C-terminal α-helix spontaneously in solution, consistent with circular dichroism data on the peptide. The observed aromatic side chain stacking ($His8_{AP}$, $Tyr12_{AP}$, $Phe13_{AP}$) enforces a tight turn that can be only accomplished by glycine at position $11_{AP}$. This structural constraint is reflected by dramatic losses in binding affinity upon replacement of $Gly11_{AP}$ by any other amino acid. The conformation of the N-terminal loop segment is partly stabilized by a D-proline, known to induce a tight turn conformation, and a 1-4 hydrogen bond by the carbonyl oxygen of Ser3 with the amide nitrogen of $Asn6_{AP}$. All ring side chains ($Tyr1_{AP}$, $Pro5_{AP}$, $His8_{AP}$, $Tyr12_{AP}$, $Phe13_{AP}$) point towards the same direction, enabling them to interact with the KD1 domain of TFPI.

Interaction of JBT1857 and KD1:

The interactions between JBT1857 and KD1 were determined. Hydrophobic contacts are interactions having an intermolecular distance of ≤4 Å, while hydrogen bonds have a distance between 2.6-3.2 Å. $Phe1_{AP}$ interacts non-specifically with TFPI making contacts with Phe2 and Ala27. In contrast, $Gln2_{AP}$ contacts a deeply buried pocket of TFPI and makes hydrophobic interactions with Phe28, Lys29, Ile46 and Phe47. Moreover, the amide group of $Gln2_{AP}$ forms three H-bonds with Phe28-CO, Phe44-CO and Ile46-NH. The Ω-loop of JBT1857, comprising Ser3$_{AP}$-Asn6$_{AP}$, mediates rather limited hydrophobic interactions with the protein; Ser3$_{AP}$, Pro5$_{AP}$ and Asn6$_{AP}$ interact with Lys29 and Phe47. Val7$_{AP}$ of JBT1857's intermediate segment also binds to Lys29 and Phe47. His8$_{AP}$ mainly contributes intramolecular aromatic stacking interactions with Tyr12$_{AP}$ and partly with Phe13$_{AP}$, and exhibits a hydrophobic interaction with Ala30 of TFPI. Similarly, the glycine-loop Val9$_{AP}$-Gly11$_{AP}$ contributes few contacts with the Kunitz domain. Val9$_{AP}$ interacts directly with KD1 by forming a hydrogen bond with the carbonyl group of Ala30 and a hydrophobic interaction with Asp32. Tyr12$_{AP}$ mediates a hydrogen bond via its hydroxyl group with the amide nitrogen of Ile55 and a hydrophobic interaction with Asp30. Leu16$_{AP}$ is part of a hydrophobic contact with Ile55. Beside the largely hydrophobic interactions of the C-terminal helix of the peptide with the protein, there are electrostatic interactions between Arg15$_{AP}$ and Asp32. Furthermore, Lys19$_{AP}$ contributes to binding with TFPI by forming a hydrogen bond to the carbonyl group of Ala37 and contacts with Lys36 and Ile38. The TFPI contact surface has an overall hydrophobic character with some charted hot spots, and a driving force of complex formation with JBT1857 is the steric surface complementarity.

This example describes characterization of the secondary structure of exemplary peptides of the invention and correlates the structure with inhibitory function of the peptides. The example also identifies the TFPI amino acid residues that interact with JBT1857, a TFPI-binding peptide that inhibits TFPI activity.

Example 8

The following example describes additional TFPI-binding peptides modified by the addition of moieties that enhance physicochemical or pharmacokinetic properties of the peptides. The example further describes a method for assessing clot formation in whole blood using rotation thromboelastography.

JBT1857 (JBT0047 peptide family) was conjugated to different PEG moieties, and the binding affinity and TFPI inhibitory activity of the PEGylated peptides were examined. JBT1857 was modified by addition of a C-terminal cysteine to produce JBT2315 (Ac-FQSKpNVHVDGYFERL-Aib-AKLC-NH2 (SEQ ID NO: 4077)), which was conjugated at the C-terminus with linear maleimide PEG moieties of increasing size: 5 kD, 12 kD, 20 kD, 30 kD, and 40 kD, using the methods described in Example 5. The resulting PEGylated peptides were designated as follows:

TABLE 13

| Peptide | PEG (kD) | Sequence | SEQ ID NO |
|---------|----------|----------|-----------|
| JBT1857 | — | Ac-FQSKpNVHVDGYFERL-Aib-AKL-NH2 | 4020 |
| JBT2317 | — | Ac-FQSKpNVHVDGYFERL-Aib-AKLC(NEM)-NH2 | 4078 |
| JBT2325 | 5.3 | Ac-FQSKpNVHVDGYFERL-Aib-AKLC(PEG)-NH2 | 4086 |
| JBT2326 | 12.1 | Ac-FQSKpNVHVDGYFERL-Aib-AKLC(PEG)-NH2 | 4087 |
| JBT2327 | 21.0 | Ac-FQSKpNVHVDGYFERL-Aib-AKLC(PEG)-NH2 | 4088 |

TABLE 13-continued

| Peptide | PEG (kD) | Sequence | SEQ ID NO |
|---------|----------|----------|-----------|
| JBT2328 | 29.1 | Ac-FQSKpNVHVDGYFERL-Aib-AKLC(PEG)-NH2 | 4089 |
| JBT2329 | 41.5 | Ac-FQSKpNVHVDGYFERL-Aib-AKLC(PEG)-NH2 | 4090 |

Stability, Binding Affinity, and TFPI-Inhibitory Activity of PEGylated Peptides

The PEGylated peptides demonstrated significantly increased plasma stability in mouse and human plasma. The peptides were added to samples of mouse or human plasma, and the percentage of the initial amount of peptide remaining in plasma 24 hours after the addition was measured by IC$_{50}$ ELISA on Maxisorp plates coated with 0.05 mg/ml TFPI (2.26 nM tracer peptide JBT2271). Less than approximately 10% of the initial amount of JBT1857 and JBT2317 remained in plasma, while 40% or more of the initial amount of the PEGylated TFPI-binding peptides remained after 24 hours. Approximately 60% or more of JBT2327 and JBT2329 was detected. PEGylated peptides also are significantly more stable in human plasma compared to unmodified peptides. Approximately 60% or more of PEGylated peptide remained after 24 hours. The unmodified peptides were more stable in human plasma than mouse plasma; about 20% or more of the initial amount remained after 24 hours of incubation.

The PEGylated peptides also were characterized in the assays described in Examples 1-4 and compared to JBT1857. Representative results are provided in Table 14 set forth below. The thrombin generation assay was performed as described in Example 4, and the results are provided as EC$_{50}$, corresponding to the concentration of peptide which improved peak thrombin (nM) half maximal.

TABLE 14

| | PEG (kD) | Biacore K$_D$ (nM) | Competition ELISA IC$_{50}$ (nM) | FXa Inhibition EC$_{50}$ (nM) | Extrinsic Tenase Inhibition EC$_{50}$ (nM) | Thrombin generation in human FVIII-inhibited plasma EC$_{50}$ (nM) |
|---|---|---|---|---|---|---|
| JBT1857 | | 0.061 | 3.0 | 3.7 | 6.9 | |
| JBT2317 | | 0.054 | 2.9 | 3.8 | 7.8 | 88 |
| JBT2325 | 5.3 | 0.71 | 6.6 | 10.7 | 10.7 | 35 |
| JBT2326 | 12.1 | 1.1 | 9.3 | 9.3 | 9.3 | 34 |
| JBT2327 | 21.0 | 1.3 | 10.9 | 7.2 | 7.2 | 24 |
| JBT2328 | 29.1 | 1.6 | 12.3 | 6.0 | 6.0 | 19 |
| JBT2329 | 41.5 | 1.1 | 12.6 | 6.0 | 12.8 | 19 |

*Competition ELISA performed with tracer JBT2271 (1 nM) and 0.05 µg/ml TFPI in the coating buffer.

Addition of the C-terminal cysteine blocked with NEM did not significantly influence the binding affinity of JBT2317 or the activity of the peptide in the FXa inhibition, extrinsic tenase assay, or thrombin generation assay compared to JBT1857. PEG size did not significantly impact the TFPI-binding peptides' ability to restore activity of FXa in the presence of TFPI-1. In the extrinsic tenase assay of Example 3, inhibitory activity increased with higher molecular weight PEG moieties up to 20 kD PEG. Activity did not further improve for 30 kD or 40 kD PEG moieties. In the thrombin generation assay of Example 4 using human plasma, $EC_{50}$ decreased with PEG size, and maximal inhibition of TFPI (as measured by peak FIIa (nM)) increased with PEG size. In mouse plasma, attachment of 40 kD PEG to a TFPI binding peptide increased maximal inhibition of TFPI.

The ability of PEGylated TFPI-binding peptides to restore extrinsic tenase complex activity for converting FX to FXa also was determined using a cell-based extrinsic tenase assay using the method of Example 5. Addition of the C-terminal cysteine blocked with NEM did not significantly influence the activity of JBT2317 in the cell-based extrinsic tenase assay compared to JBT1857. Conjugation of PEG moieties (5 kD, 20 kD, 30 kD, or 40 kD) to JBT2317 increased TFPI inhibitory activity by 5-20%.

Rotational Thromboelastography

Continuous visco-elastic assessment of human whole blood clot formation and firmness was performed by rotation thromboelastography with whole blood preparations in the presence or absence of peptides. Blood samples from a healthy individual were drawn into citrated Sarstedt Mono S (0.106 M or 3.2% (w/v) Na-citrate) (5 ml), mixing one part of citrate with nine parts blood, using a 21 gauge butterfly needle. A portion of the blood samples was incubated with high titer, heat-inactivated anti-human FVIII antiserum raised in goat (3876 BU/ml; Baxter BioScience, Vienna, Austria) resulting in 51 BU/mL. Test samples were prepared by dissolving quantities of peptides in either DMSO or HEPES buffered saline (with or without 0.1% Tween 80).

Recordings were made using a ROTEM thromboelastography coagulation analyzer (Pentapharm, Munich, Germany) at 37° C. Briefly, blood is added into a disposable cuvette in a heated cuvette holder. A disposable pin (sensor) is fixed on the tip of a rotating axis. The axis is guided by a high precision ball bearing system and rotates back and forth. The axis is connected with a spring for the measurement of elasticity. The exact position of the axis is detected by the reflection of light on a small mirror on the axis. The loss of elasticity when the sample clots leads to a change in the rotation of the axis. The data obtained are computer analyzed and visualized in a thromboelastogram. The thromboelastogram shows elasticity (mm) versus time (s). An elasticity of approximately zero is observed before clot formation begins. Mirror image traces above and below the zero line indicate the effect of clot formation on the rotation of the axis.

Before starting each experiment, the citrated whole blood was mixed with corn trypsin inhibitor (CTI) (Hematologic Technologies, Inc., Essex Junction, Vt., USA) providing a final concentration 62 μg/mL for specific inhibition of FXIIa, in order to inhibit FXIIa-mediated contact activation. The analytical set-up was as follows: to 20 μL of test sample or control, 300 μL of pre-warmed (37° C.) CTI treated citrated whole blood was added, followed by 20 μL of a 1:15 dilution of TF PRP reagent containing recombinant human tissue factor (rTF, 3 pM) (TS40, Thrombinoscope BV, Maastricht, The Netherlands). Coagulation was initiated by the addition of 20 μL 200 mM $CaCl_2$ (Star-TEM®, Pentapharm, Munich, Germany) and recordings were allowed to proceed for at least 120 min. The final concentration of rTF in the assay was 11 or 44 fM.

The thromboelastographic parameters of clotting time (CT), clot formation time (CFT) and maximum clot firmness (MCF) were recorded in accordance with the manufacturer's instructions. CT is defined as the time from the start of measurement to the start of clot formation. CFT is defined as the time from the start of clot formation until an amplitude of 20 mm is reached. MCF is the maximum difference in amplitude between the two traces during the assay. The first derivative of the data of the thromboelastogram are plotted to obtain a graph of velocity (mm/s) against time (s). From this graph, the maximum velocity (maxV) is determined. The time at which the maximum velocity is obtained (maxV-t) is also determined.

Figure 56:
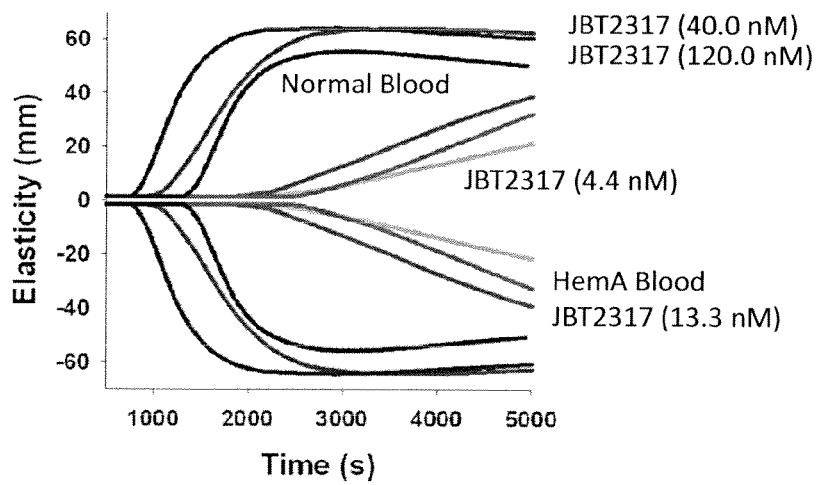
FIG. 56 is a rotational thromboelastogram correlating sample elasticity (mm) with time in seconds (s) for JBT2317.
Figure 57:
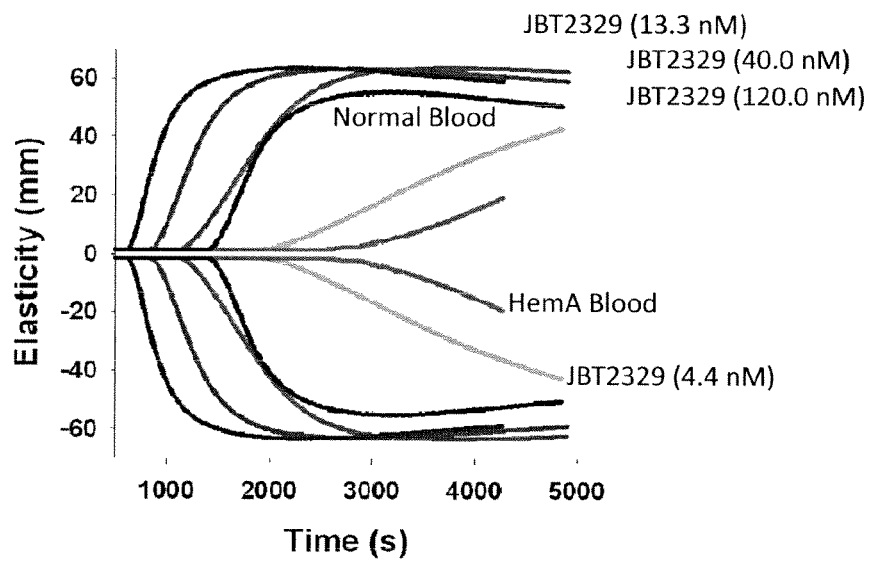
FIG. 57 is a rotational thromboelastogram correlating sample elasticity (mm) with time in seconds (s) for JBT2329.

Exemplary results are illustrated in FIGS. 56 and 57. JBT1857 and JBT2317 restored coagulation parameters in Hem A blood. PEGylated (40 kD) TFPI-binding peptide JBT2329 also restored prolonged coagulation parameters in Hem A blood, as illustrated in FIG. 57. PEGylation of JBT2317 reduces clot time and clot formation time.

Nail Clip Study

The effect of JBT2329 on blood loss in naïve mice also was studied. C57BL6 mice were administered vehicle, 1 mg/kg JBT2329, or 0.1 mg/kg JBT2329 (N=19 or 20 for each group) intravenously 30 minutes prior to nail clip at 10 ml/kg. Animals were anaesthetized 10 minutes before nail clip with 80 mg/kg pentobarbital (i.p.). At time=0 minutes, the nail of the small toe of the right hind paw was cut just before the nail bed. The paw was transferred to a vial prefilled with 0.9% NaCl solution. Samples of blood were collected for analysis during the first 30 minutes following the nail clip and the next 30 minutes thereafter, and mean collected volume for the groups was calculated and compared. Mean blood loss in vehicle treated mice was about 30.5 μl over the first 30 minutes, 52.1 over the second 30 minute period, resulting in about 82.6 μl of blood loss over 60 minutes. In contrast, administration of 0.1 mg/kg JBT2329 reduced blood loss by about 50% over the first 30 minutes (16.0 μl) and about 64% over the second 30 minute period (18.7 μl), resulting in about a 60% reduction of total blood loss over 60 minutes (34.7 μl) compared to vehicle-treated mice. Increasing the dose of JBT2329 to 1.0 mg/kg further reduced blood loss by at least about 10%; 12.2 μl was collected over the first 30 minutes, 10.6 μl was collected over the second 30 minute period, resulting in 22.8 μl collected over the entire 60 minute collection period. JBT2329 also efficiently reduced bleeding when administered subcutaneously compared to vehicle-treated naïve mice; subcutaneous injection of 10 mg/kg JBT2329 reduced blood loss during the 60 minutes following nail clip by approximately 58% compared to vehicle-treated subjects.

The results described above were generated using a JBT1857 derivative comprising a linear PEG moiety attached to the C-terminus of the peptide and a JBT1586 derivative comprising a PEG moiety at the N-terminus. Peptides comprising an alternate conjugation site or alternative chemical moiety also were generated. A 40 kD linear PEG moiety was conjugated to residue 14 of JBT1857 to generate JBT2404. The linear 40 kD PEG moiety of JBT2329 was replaced with a 40 kD branched PEG moiety to generate JBT2401. JBT1857 also was modified to comprise K(Ttds-Maleimidopropionyl) (JBT2374) at the C-terminus. JBT2374 was used to generate JBT2410, an HSA conjugate of JBT2374. JBT2375, a K(AOA)-comprising derivative of JBT1857, was used to couple PSA aldehyde to the peptide JBT1857, resulting in JBT2430. JBT2401, JBT2404, JBT2410 and JBT2430 were characterized using the assays described above. Representative results are summarized in Table 15:

TABLE 15

|  | Biacore $K_D$ (nM) | ELISA affinity $EC_{50}$ (nM) | FXa Inhibition $EC_{50}$ (nM) | Human Plasma Stability, 24 hour (%) | Thrombin generation in human FVIII-inhibited plasma $EC_{50}$ (nM) |
|---|---|---|---|---|---|
| JBT2329 | <1 | 12.6 | 6 | 67.3 | 1.4 |
| JBT2401 | <1 | 22.4 | 7.7 | 85.1 | 1.4 |
| JBT2404 | <1 | 18.2 | 13.4 | 96.7 | 1.7 |
| JBT2410 | n.d. | 5.1 | 4.7 | 65.7 | 1.8 |
| JBT2430 | n.d. | 5.6 | 9.0 | 135.6 |  |

This example demonstrates that an exemplary TFPI-binding peptide of the invention, JBT1857, is a potent inhibitor of TFPI and can be functionalized and conjugated with PEG without loss of activity. PEGylation increased TFPI-inhibitory activity in several functional assays. Surprisingly, peptides conjugated to higher weight PEG moieties demonstrated enhanced TFPI inhibitory activity. JBT2329, comprising a 40 kD linear PEG moiety, significantly reduced blood loss in a clinically-relevant animal model. PEG conjugation within the amino acid sequence of JBT1857, use of a branched PEG moiety, and attachment of HSA and PSA did not destroy the activity of the peptide.

Example 9

The following example describes the characterization of two TFPI-binding peptides of the invention, JBT1837 and JBT1857. JBT1837 (Ac-SYYKWH[CAMRDMKGTMTC]VWVKF-NH) (SEQ ID NO: 1044) is a cyclic peptide of the JBT0120 family that binds KD1 and KD2 of TFPI. JBT1857 (Ac-FQSKpNVHVDGYFERL-Aib-AKL-NH2) (SEQ ID NO: 178) is a linear peptide of the JBT0047 family that binds KD1 of TFPI. The affinity and TFPI-inhibitory activity of JBT1837 and JBT1857 were examined using the assays described in Examples 1-4, the results of which are summarized in Table 16.

tially inhibited TFPI activity. $EC_{50}$'s also were higher when flTFPI was used in the FXa inhibition study.

In the extrinsic tenase assay, about 85% of truncated TFPI was inhibited by both peptides. Full length TFPI activity was inhibited about 56% and 48% by JBT1837 and JBT1857, respectively. Surprisingly, in the cell-based extrinsic tenase assay, JBT1837 inhibited the activity cell-associated TFPI by about 50% whereas JBT1857 almost fully inhibited cell-bound TFPI activity. In the plasma-based functional assay, JBT1837 inhibited TFPI more efficiently than JBT1857 in human FVIII-inhibited plasma and FIX-deficient plasma. JBT1837 corrected blood coagulation parameters in FVIII-inhibited blood in the ROTEM assay described in Example 8. JBT1857 also positively impacted blood coagulation parameters, but performed less efficiently than JBT1837 in the assay.

This example compared the affinity and TFPI-inhibitory activity of cyclic and linear TFPI-binding peptides that target different regions of the TFPI protein. JBT1837 (a cyclic peptide belonging to family JBT0120) and JBT1857 (a linear peptide belonging to family JBT0047) efficiently bind human TFPI with affinities less than 1 nM and are potent inhibitors. FXa-TFPI interaction is fully blocked at low TFPI concentrations by both peptides, while TFPI inhibition by JBT1857 is reduced in the presence of higher concentrations of TFPI. Both peptides partially inhibit the activity of full-length TFPI in the extrinsic tenase assay, and JBT1857 inhibits TFPI activity to a greater degree in the cell-based extrinsic tenase assay compared to JBT1837. Compared to JBT1857, JBT1837 more efficiently inhibits TFPI in FVIII-deficient plasma. Both peptides improve coagulation parameters of FVIII-inhibited human whole blood by reducing clot time, while JBT1857 improves clot formation velocity to a lesser degree compared to JBT1837.

Example 10

This example illustrates the in vivo activity of TFPI-binding peptides of the invention in a clinically-relevant animal model. As described below, an exemplary TFPI-binding pep-

TABLE 16

|  | Biacore $K_D$ (nM) | ELISA affinity $EC_{50}$ (nM) | FXa Inhibition; R&D TFPI/flTFPI $EC_{50}$ (nM) | Extrinsic Tenase Inhibition; R&D TFPI/flTFPI $EC_{50}$ (μM) | Thrombin generation in human FVIII-inhibited plasma $EC_{50}$ (nM) | Thrombin generation in human FIX-deficient plasma $EC_{50}$ (nM) |
|---|---|---|---|---|---|---|
| JBT1837 | <1 | 4.8 | 3.2/5.9 | 0.5/0.9 | 10 | 16 |
| JBT1857 | <1 | 3.0 | 3.7/21.9 | 6.9/13.6 | 69 | 51 |

Affinity of the peptides to human TFPI measured via BiaCore was less than 1 nM. Affinity measured by ELISA ($IC_{50}$) was 4.8 nM for JBT1837 and 2.5 nM for JBT1857. JBT1837 dissociated from human TFPI more slowly than JBT1857 (i.e., JBT1837 remained bound to human TFPI for a longer period of time compared to JBT1857). A FXa inhibition assay was performed using both full length human TFPI ("flTFPI") and truncated human TFPI (254 amino acids "R&D TFPI") (0.1 nM FXa, 0.5 nM TFPI, 0.25% DMSO). Activity of the truncated TFPI was fully inhibited by both JBT1837 and JBT1857 at 0.5 nM TFPI, while full length TFPI was inhibited 85% and 95% by JBT1857 and JBT1837, respectively. At higher concentrations of flTFPI (e.g., 10 nM flTFPI), JBT1837 fully inhibited TFPI activity, while JBT1857 partide significantly reduced blood loss in an animal when administered with suboptimal doses of FVIII and FIX.

JBT2329, a PEGylated (40 kD) TFPI-binding peptide (JBT0047 family) that cross-reacts with human and murine TFPI, was tested in tail-tip bleeding model in FVIII knock-out mice and FIX knock-out mice. FVIII knock-out mice closely minor the condition of hemophilia A patients, and the tail-tip bleeding model is widely used in research to assess efficacy of drugs by measuring, e.g., bleeding time, blood loss or survival. ADVATE, a commercially available rFVIII, served as a reference, and ADVATE buffer-treated animals served as negative controls. Each group contained 16 FVIII knock-out mice (8 female+8 male). JBT2329 (1 mg/kg or 0.1 mg/kg) or anti-TFPI antibody (maTFPI; 18 mg/kg) was administered 30 minutes before the tail-tip was cut. ADVATE (10 IU/kg or 50 IU mg/kg) or ADVATE buffer was administered five minutes before the tail was cut off. Test and control substances were administered as an intravenous bolus via a lateral tail vein injection. Animals were anaesthetized by an intraperitoneal injection of 100 mg/kg ketamine and 10 mg/kg xylazine. Approximately 10 minutes later, 2 mm of the tail-tip was cut off. The tail-tips were placed in warm saline (approximately 37° C.) and blood was collected over an observation period of 60 minutes. The amount of blood was determined gravimetrically. At the end of the observation period of 60 minutes the animals were humanely killed by cervical dislocation before recovery from anesthesia.

Median total blood loss in buffer-treated animals was 930 mg. Median total blood loss in subjects treated with murine anti-TFPI antibody (maTFPI) was 724 mg. The reduction in median total blood loss was more pronounced when the subjects were administered maTFPI with ADVATE. A combination of maTFPI+10 IU/kg ADVATE led to a median total blood loss of 136 mg, animals treated with maTFPI+50 IU/kg ADVATE experienced a median total blood loss of 13 mg. Median blood losses of animals treated with either 10 or 50 IU/kg ADVATE alone experienced median blood loss of 798 and 364 mg, respectively. The superiority of the combination treatment of maTFPI+ADVATE over ADVATE alone was statistically shown for maTFPI+50 IU/kg ADVATE versus 50 IU/kg ADVATE (p=0.0010). Although not statistically significantly superior, blood loss in animals treated with maTFPI+10 IU/kg ADVATE was distinctively lower than in animals treated with 10 IU/kg ADVATE alone.

Efficacy, defined as statistically significant superiority over buffer at a 2.5% level, was shown for JBT2329 dosed at 1 mg/kg in combination with 10 and 50 IU/kg ADVATE and dosed at 0.1 mg/kg in combination with 50 IU/kg ADVATE (p<0.0004). Animals treated with JBT2329 in combination with ADVATE showed a clinically-relevant reduction in blood loss, although the results were not statistically significant (p≥0.0506). Administration of 1 mg/kg JBT2329 without ADVATE did not reduce median total blood loss over that observed in buffer-treated animals (930 mg).

JBT2329 also was tested in a FIX knock-out tail-tip bleed mouse model, which is a clinically-relevant model for hemophilia B human patients. The methodology was substantially similar to that described above with respect to the FVIII knock-out model. Instead of ADVATE, a recombinant FIX (rFIX) served as a reference. Median total blood loss in buffer-treated animals was 935 mg. Median total blood loss in animals treated with a murine anti-TFPI antibody (maTFPI) was 774 mg. Median total blood loss was reduced further when the animals received combined treatment of maTFPI and rFIX. A combination of maTFPI+10 IU/kg rFIX led to a median total blood loss of 25 mg, while animals treated with maTFPI+50 IU/kg rFIX exhibited a median total blood loss of 10 mg. Median blood loss of animals treated with either 10 or 25 IU/kg rFIX alone experienced a median blood loss of 888 and 774 mg, respectively.

Efficacy, defined as statistically significant superiority over buffer at a 2.5% level, was shown for JBT2329 when dosed at 1 mg/kg in combination with 10 IU/kg rFIX and at 0.1 mg/kg in combination with 10 IU/kg rFIX. The superiority of JBT2329 in combination with rFIX over administration of rFIX alone was observed (p<0.0172), while treatment with 1 mg/kg JBT2329 alone did not lead to a significant reduction in median total blood loss compared with buffer-treated animals (p=0.321).

In summary, JBT2329 promoted a clinically-relevant reduction of blood loss when co-administered with suboptimal doses of FVIII and rFIX at all doses tested. Furthermore, intravenous administration of JBT2329 was well tolerated in all subjects across all treatment groups without any signs of acute toxicity.

Example 11

The TFPI-binding peptides described herein are suitable for detecting TFPI in a sample, such as biological sample. This example describes a method for detecting TFPI using the inventive peptides in an ELISA-like assay format.

The peptide sequence of JBT1857 was N-terminally modified by the addition of a biotinyl-Ttds moiety to generate JBT2271 (Biotinyl-Ttds-FQSKpNVHVDGYFERL-Aib-AKL-NH2 (SEQ ID NO: 4033)). A 96-well microtiter plate (Maxisorp, Nunc) was coated with 50 µl per well coating buffer (15 mM $Na_2CO_3$, 35 mM $NaHCO_3$, pH 9.3) containing a range of TFPI concentrations (0-3 µg/ml, human recombinant TFPI, R&D Systems) for 1 hour at room temperature. The plate was washed three times with 350 µl/well wash buffer (175 mM NaCl, 5 mM $CaCl_2$, 25 mM HEPES, 0.1% Tween 80, pH 7.35). The plate was then blocked with 100 µl blocking buffer (2% yeast extract, 175 mM NaCl, 5 mM $CaCl_2$, 25 mM HEPES, 0.1% Tween 80, pH 7.35) for 1 hour at room temperature. The plate was then washed three times with 350 µl wash buffer. Fifty µl of differently concentrated JBT2271 solutions in wash buffer (100-0 nM) were added to each well. The plate was incubated for 1 hour and washed three times with 350 µl wash buffer. To each well, 50 µl streptavidin-horseradish peroxidase conjugate (R&D Systems, 1:200 in wash buffer) is added. After an incubation period of 1 hour at room temperature, the plate was washed three times with wash buffer. Fifty µl TMB solution (SeramunBlau fast, Seramun) was added to each well. After a 1.5 minute incubation at room temperature, the reaction was stopped by adding 50 µl 1 M $H_2SO_4$ per well. Absorbance was measured in a photometer (Molecular Devices Spectramax M5) at 450 and 620 nm.

JBT2271 allowed detection of as little as $4.1 \times 10^{-14}$ mole of TFPI per well. The results of the assay described above illustrate that the inventive peptides are powerful tools for identifying and/or quantifying TFPI in a sample.

Example 12

This example describes conditions for an exemplary $k_{off}$ assay for characterizing TFPI-binding peptides.

Wells of a microtiter plate (96 wells, Maxisorp, Nunc) are coated with 1.6 nM TFPI in coating buffer (15 mM $Na_2CO_3$, 35 mM $NaHCO_3$, pH 9.3) for two hours at room temperature. The plate is then washed three times with 350 µl wash buffer (175 mM NaCl, 5 mM $CaCl_2$, 25 mM HEPES, 0.1% Tween 80, pH 7.35), and wells are blocked with 100 µl blocking buffer (2% yeast extract, 175 mM NaCl, 5 mM $CaCl_2$, 25 mM HEPES, 0.1% Tween 80, pH 7.35). If an incubation period of 24 hours is employed, the wells are blocked for at least one hour. Control wells used for a 15 minute incubation period are blocked for an additional 23.5 hours.

For a 24 hour incubation period, the wells are washed three times with 350 µl wash buffer and are incubated with 50 µl test peptide in wash buffer. The concentration of test peptide depends on the individual $IC_{90}$ concentration determined in, e.g., the TFPI $IC_{50}$ ELISA assay described herein. The TFPI-coated wells are exposed to test peptide for approximately 15 minutes. The wells are subsequently washed three times with 350 µl wash buffer and 50 µl tracer peptide (competitor) is added. An exemplary tracer peptide is JBT2271 (1.13 nM in wash buffer). Control wells (maximum signal) are incubated with tracer only. Blank wells lacking TFPI are incubated with tracer only. Addition of the tracer peptide commences the 24 hour incubation period.

A 15 minute incubation period is employed as a control if the $IC_{90}$ concentration of the test peptide leads to a 90% reduction of the maximum signal. Wells blocked for an additional 23.5 hours are washed three times with 350 µl wash buffer to remove the blocking buffer. Subsequently, 50 µl analyte in wash buffer is added and the wells are incubated for 15 min. The concentration of test peptide utilized depends on the peptide's $IC_{90}$ concentration determined using, e.g., a TFPI $IC_{50}$ ELISA assay. The 15 minute incubation is followed by three washes with 350 µl wash buffer and addition of 50 µl tracer peptide. Control wells (maximum signal) are incubated with tracer only. Blank wells lacking TFPI also are incubated with tracer only.

The plate is washed three times with 350 µl wash buffer, and 50 µl streptavidin-horseradish peroxidase conjugate (R&D Systems, 1:200 in wash buffer) is added to each well. After an incubation period of one hour at room temperature, the plate is washed three times with wash buffer. TMB solution (50 µl per well; SeramunBlau fast, Seramun) is added. After a 1.5 minute incubation at room temperature, the reaction is stopped by the addition of 50 µl 1 M $H_2SO_4$ per well. Absorbance is measured using a photometer (Spectramax M5, Molecular Devices) at 450 and 620 nm. The assay results are presented as a percentage of the corrected optical density (OD450-OD620) of wells exposed to test peptide and tracer peptide in relation to TFPI-coated wells exposed only to tracer.

Example 13

TFPI inhibits FVIIa/TF activity by binding to FVIIa via Kunitz domain 1 (KD1). This example describes an exemplary method for evaluating the influence of TFPI-binding peptides on TFPI's inhibition of FVIIa/TF.

Kinetic measurements were performed in 25 mM HEPES, 175 mM NaCl, 5 mM $CaCl_2$, 0.1% BSA, pH 7.3 at 25° C. in 96-well microtiter plates. Twenty µl soluble tissue factor (residues 33-251; Creative Biomart) and 20 µl FVIIa (ERL) at final concentrations of 100 nM and 5 nM, respectively, were mixed and incubated for 15 minutes. Twenty µl of TFPI-binding peptide in varying final concentrations (0-2 µM) were added to the mixture and incubated for a further 15 minutes.

In order to measure the residual activity of the FVIIa/sTF complex, the reaction mixture was incubated for 60 minutes with 20 µl TFPI (200 nM). The reaction was initiated by the addition of a chromogenic substrate, Chromozym-tPA (Roche) (1 mM). The change in absorbance at 405 nm was monitored by using a Labsystems iEMS ELISA Reader for 30 minutes. FVIIa/sTF activity measured in the absence of TFPI was considered "100% activity" in the context of the assay. By plotting peptide concentration against residual activity, $EC_{50}$ values were determined.

JBT1857 and JBT1837 were screened against TFPI160, TFPI1-150-Thrombin, NTermKD1, KD1, and KD2 (negative control). JBT1857 demonstrated an $EC_{50}$ of approximately 0.21-0.23 µM for TFPI160, TFPI1-150-Thrombin, NTermKD1, and KD1. JBT1837, which binds KD1 and KD2, demonstrated an $EC_{50}$ of approximately 0.17-0.19 µM for TFPI160 and TFPI1-150-Thrombin, while activity in assays involving NTermKD1 and KD1 was approximately background.

The results described above demonstrate that TFPI-binding peptides efficiently inhibit TFPI-FVIIa/TF interaction. JBT1857 efficiently inhibited TFPI fragments containing KD1 as a minimal functional entity. Thus, this enzymatic assay confirms X-ray crystallographic data placing the binding site of JBT1857 within KD1. JBT1837 inhibited TFPI fragments containing the first two Kunitz domains, suggesting that the JBT1837 binding site(s) are located within KD1-linker-KD2 region of TFPI. A combination of Kunitz domains and fragments of a thrombin cleaved TFPI (1-150) did not restore inhibitory activity of JBT1837 in the chromogenic assay. The enzymatic assay described herein is a suitable surrogate for detecting binding of a TFPI-binding peptide (or a test compound) to TFPI, and is useful for examining the TFPI-inhibitory effect of TFPI-binding compounds.

Example 14

This example describes the influence of PEG and HSA conjugation on exemplary TFPI-binding peptides in vivo.

For pharmacokinetic analysis, C57B16 mice were treated with various TFPI-binding peptides conjugated to different molecular weight PEGs and HSA. The dose of the peptide-PEG and peptide-HSA conjugates was normalized to 1 mg/kg (peptide content). Normalization assures comparability between the conjugates of different molecular weight. The peptide conjugates were dissolved in 175 mM NaCl, 25 mM HEPES pH 7.35 and administered intravenously via the tail vein or subcutaneously in the neck region. Blood draws were taken from three animals (retro bulbar) and collected in heparinized vials at several time points following administration. The samples were centrifuged, and the peptide-conjugate content in plasma was quantified by ELISA.

Figure 63:
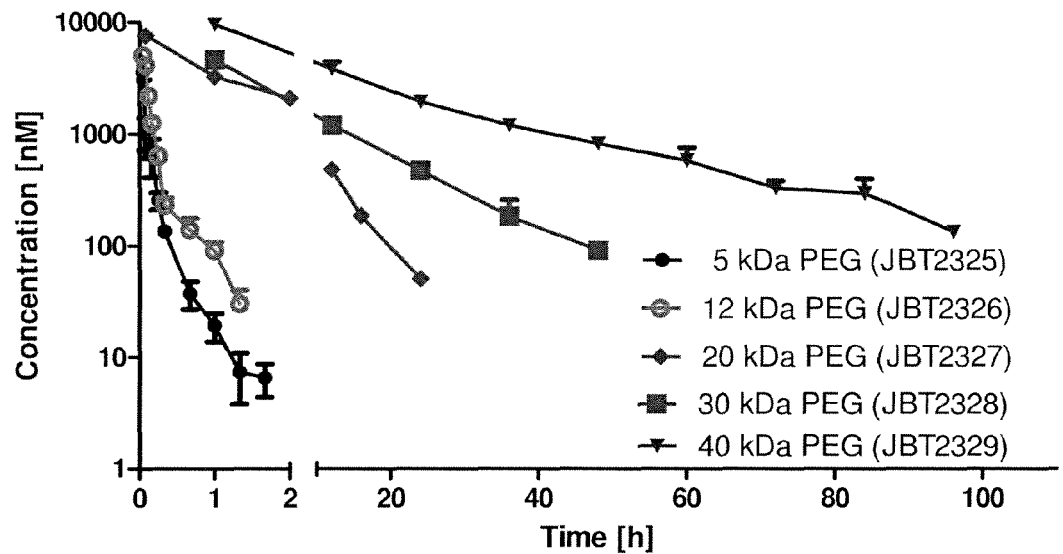
FIG. 63 is a graph correlating concentration of peptides JBT2325-JBT2329 (nM) (y-axis) with time following intravenous administration (hours) (x-axis). Peptides comprising higher weight PEG moieties exhibited a prolonged in vivo half life in mice. Each time point is represented by the mean of three independent samples quantified by ELISA.

FIG. 63 illustrates the concentration of PEGylated TFPI-peptides detected in plasma at several time points following administration, and Table 17 provides detailed information about the terminal half life and bioavailability of JBT2325-JBT2329, JBT2401, JBT2404 and JBT2410.

TABLE 17

| | JBT2325 | JBT2326 | JBT2327 | JBT2328 | JBT2329 | JBT2401 | JBT2404 | JBT2410 |
|---|---|---|---|---|---|---|---|---|
| HL_λ_z [h] (intravenous) | 0.16 | 0.35 | 4.2 | 10.1 | 19.8 | 20.7 | 12.3 | 7.8 |
| Bioavailability [%] (s.c.) | 58.2 | 76.0 | 89.7 | 52.0 | 73.3 | 58.4 | 59.3 | 46.6 |

JBT2329, JBT2401 and JBT2404 are peptides conjugated to 40 kDa linear PEG (JBT2329 and JBT2404) or 40 kDa branched PEG (JBT2401). The 40 kDa conjugates exhibited a longer terminal half-life (HL_λ_z) compared to peptides conjugated to smaller PEGs following intravenous administration. The area under curve (AUC) of the concentration-time curve resulting from subcutaneous administration of the peptides was compared to the AUC generated following intravenous administration to calculate the bioavailability of the peptides. Results are shown in Table 16. The data demonstrate that TFPI-binding peptide conjugation to higher molecular weight molecules allows a subcutaneous bioavailability of more than 30%.

Figure 64A:
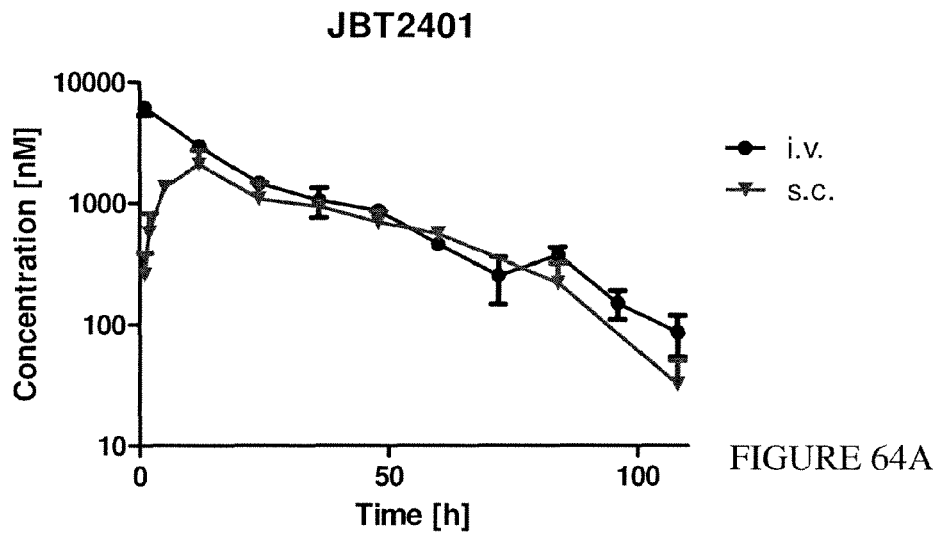
FIG. 64A-64C are graphs correlating concentration of peptides JBT2401, JBT2404 and JBT2410 (nM) (y-axis) with time following intravenous administration (hours) (x-axis). Each time point is represented by the mean of three independent samples quantified by ELISA. Solid circles symbolize intravenous data, solid triangles symbolize subcutaneous data.
Figure 64B:
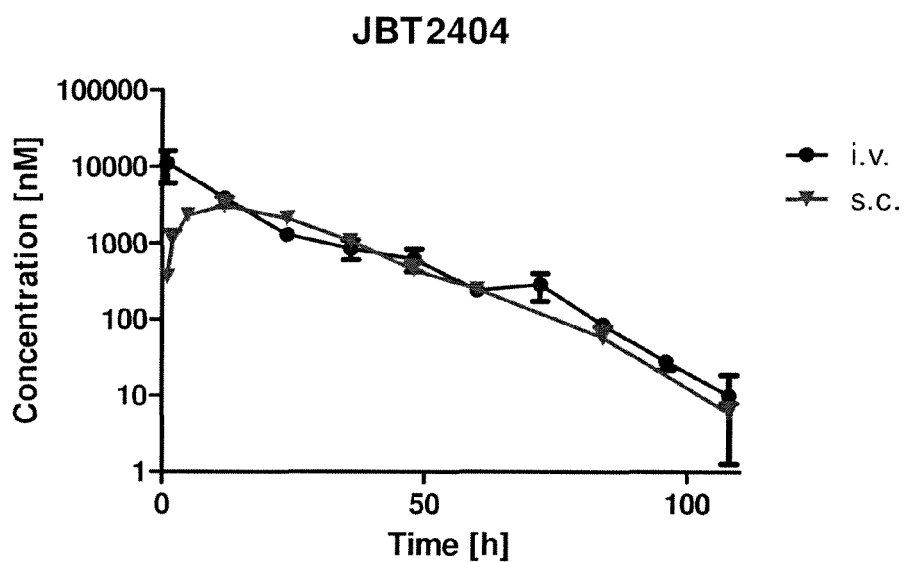
Figure 64C:
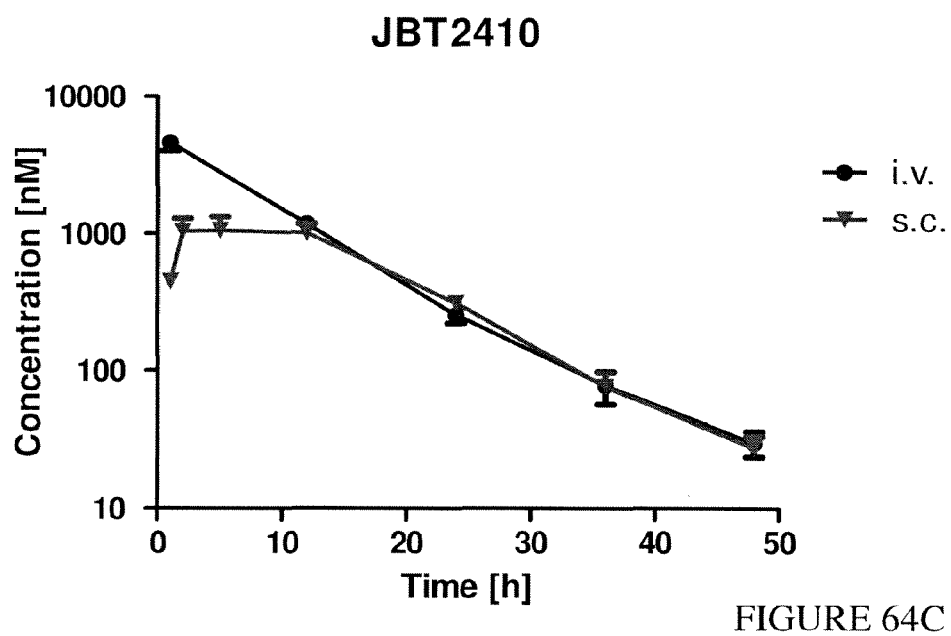

FIGS. 64A-C illustrate the pharmacokinetic profile of JBT2401, JBT2404, and JBT2410 resulting from subcutaneous and intravenous administration of the peptides to mice. JBT2404 comprises a PEG conjugated to cysteine in position X4014 relative to formula (XI). JBT2401 comprises a branched PEG, and JBT2410 is conjugated to HSA. FIG. 64A demonstrates that fusion of a higher molecular weight molecule to a TFPI-binding peptide at an internal position increases half life. Half life also is increased if using branched PEG (JBT2401) and HSA, which increased the in vivo half life of JBT2410 compared to conjugates having smaller-sized PEGs (e.g., JBT2325) or free peptide (see FIG. 31).

This example illustrates that the in vivo properties of various peptides described herein can be improved by conjugation with higher molecular weight molecules (like PEG) and/or with nFcR ligands (like HSA).

Example 15

The following example describes the characterization of JBT1837's interaction with KD1-KD2 of TFPI, alone and in the presence of JBT1857, via X-ray crystallography.

Native-PAGE

Native-PAGE was performed to confirm that TFPI-binding peptides that bind different regions of TFPI could bind TFPI KD1-KD2 simultaneously. Fifteen percent polyacrylamide-gels (without SDS) were used for the native gel-electrophoresis on samples comprising (1) a TFPI fragment comprising KD1-KD2, (2) KD1-KD2 and JBT1857, (3) KD1-KD2 and JBT1837, and (4) KD1-KD2 with both JBT1857 and JBT1837. Glycerine and Ponceau red were added to the protein samples. The anode buffer was obtained by dissolving 25 mM imidazole in 1 liter water and adjusting the pH to 7 with HCl. Clear cathode buffer was prepared by dissolving 7.5 mM imidazole and 50 mM tricine in one liter of water. Water was added to each solution to reach a final volume of two liters. Serva Blue G (0.02% w/v final) was added to two liters of cathode buffer to generate blue stock 10× cathode buffer (blue stock 10×). Gels were run for 30 minutes at 80 V, then for about three hours at 250 V. The gels were stained and de-stained as described in Chakavarti et al., *J Vis Exp.*, 12; (16) (2008).

KD1-KD2 was visualized in the gel as a single band. Samples comprising K1-K2 in combination JBT1857 and/or JBT1837 resulted in a shift of the initial KD1-KD2 band to a higher molecular weight to charge ratio. After mixing of KD1-KD2 and JBT1837, partial precipitation was observed, indicating a decrease in solubility after complex formation. JBT1857 shifted the complete KD1-KD2 band, while JBT1837 shifted approximately ⅓ of the initial band. Additionally, in the presence of both JBT1837 and JBT1857, the KD1-KD2 band shifts to the highest molecular weight to charge ratio, indicating the formation of a ternary complex consisting of KD1-KD2, JBT1837 and JBT1857. Thus, JBT1837 and JBT1857 can bind TFPI simultaneously.

Materials and Methods—Interaction of JBT1837 with KD1-KD2

Crystal Growth:

Initial crystals where formed at 20° C. by mixing 0.4 µl of a 1:1 complex (1.5 mg/ml; 10 mM Tris/8.0, 100 mM NaCl) with 0.2 µl precipitant (20% w/v PEG 6000, 50 mM Imidazole pH 8.0). Crystals were reproduced at 20° C. by mixing 1 µl protein with 0.5 µl precipitant (20% w/v PEG 6000, 50 mM Imidazole pH 8.0). A cryoprotectant (30% w/v PEG 6000, 34% glycerol) was added to the crystal drop (final concentration of 25% glycerol) to protect resulting crystals from disorder and ice formation during flash cooling with liquid nitrogen.

Data Processing:

Diffraction data were collected from 87.26 Å to 1.95 Å and evaluated using the MOSFLM and iMOSFLM packages (Leslie, (2006) *Acta Crystallogr D Biol Crystallogr* 62, 48-57), followed by merging and scaling using CCP4 suite (McCoy et al., (2007) *J Appl Crystallogr* 40, 658-674). Crystals belong to the orthorhombic space group P $2_1 2_1 2_1$ with unit cell dimensions of a=42.35 Å, b=44.13 Å, c=174.53 Å, $\alpha=\beta=\gamma=90.0°$ and 2 complexes in the asymmetric unit. The Patterson search was carried out using the PHASER program (McCoy, supra) and two search ensembles, a crystal structure of KD2 (1TFX) (Burgering et al. (1997) *J Mol Biol* 269, 395-407) and a previously solved KD1 crystal structure. The unit cell contained approximately 54% solvent. Non-crystallographic electron density averaging, model building and model refinement was carried out with the programs Coot and Refmac (McCoy, supra; Murshudov et al, (1997) *Acta Crystallogr D Biol Crystallogr* 53, 240-55). The current model is completely defined for both copies of the JBT1837 peptide (23AA) and the interaction with the protein with current R=0.213, $R_{free}$=0.245, deviation from ideal geometry rms (bond)=0.0098 Å, rms(angle)=1.28°.

Analysis of the Interaction Surface:

The interaction surface of KD1-KD2 and JBT1837 was analyzed with PDBePISA. The impact of single amino acids was weighted by the total reduction of their solvent accessible area after complex formation (buried solvent accessible area BSAA) and considered by generating a 2D-interaction-matrix.

Materials and Methods—Interaction of KD1-KD2 with JBT1837 and JBT1857

Crystal Growth:

Initial crystals where formed at 20° C. by mixing 0.4 µl of a 1:1:1 complex (1.5 mg/ml; 10 mM Tris/8.0, 100 mM NaCl) with 0.2 µl precipitant (2M $(NH_4)_2SO_4$, 5% PEG 400, 100 mM MES pH 6.5). Crystals were reproduced and optimized at 20° C. by mixing 1 µl protein with 0.5 µl precipitant (1.5 M $(NH_4)_2SO_4$, 5% PEG 400, 100 mM MES pH 6.5). A cryoprotectant (2M $(NH_4)_2SO_4$, 25% glycerol) was added step-wise to the crystal drop (final concentration of 2.3M $(NH_4)_2SO_4$ and 20% glycerol) to protect the resulting crystals from disorders and ice formation during flash cooling with liquid nitrogen. The drop was covered with cryo-oil and crystals were harvested.

Data Processing:

Diffraction data were collected from 74.3 Å to 2.7 Å and evaluated using the MOSFLM and iMOSFLM packages, followed by merging and scaling using CCP4 suite (Leslie, (2006) *Acta Crystallogr D Biol Crystallogr* 62, 48-57; *Acta Crystallogr D Biol Crystallogr* 50, 760-3 (1994)). Crystals belong to the tetragonal space group P $4_3 2_1 2$ with unit cell dimensions of a=79.07 Å, b=79.07 Å, c=218.17 Å, $\alpha=\beta=\gamma=90.0°$.

X-Ray Crystallography Results

The KD1-KD2 structure is defined in the electron density from L21 through E148; while chemically present, residues D149 and G150 are conformationally disordered in two crystallographically-independent copies of the molecule.

Both domains show a Kunitz-type structure. Only ~⅓ of the structure is engaged in secondary structure elements; these are two short α-helical elements at S24-A27(KD1)/D95-F98(KD2) (α1/α3) and L69-M75/L140-E148 (α2/α4) and a two-stranded β sheet comprising M39-N45/I110-N116

(131/(33) and R49-155/K120-K126 (β2/β4). These elements form the topological framework that is stabilized by the three canonical disulfide bonds involving C26-C76, C35-059, and C51-C72 in KD1 and C95-C147, C106-C130, and C122-C143 in KD2.

This is the first structure of TFPI consisting of KD1, KD2 and their linker elucidated by X-ray crystallography. Remarkably, JBT1837 locks KD1-KD2 in a distinct conformational state in which both Kunitz-domains are related via a two-fold symmetry. Additionally the conformation of TFPI is intrinsically stabilized by two turns, a β-turn (tβ) from T77-A81 and a γ-turn (tγ) from Q90-K93. tβ is stabilized by three hydrogen bonds (O K74-N N82, O N80-Nζ K74, O N82-Nε H23) and leads to a shortening of α2 in KD1 by two residues compared to homolog Kunitz-domains and the crystal structure of KD1 alone. tγ is stabilized by four hydrogen bonds (O T88-N D95, O Q90-N K93, O K93-N Q90, Oγ T88-Oδ D95).

The 23 mer peptide JBT1837 assumes a β-hairpin like structure which can be segmented into (i) the pin, a two-stranded β sheet comprising $Y2_{AP}$-$A8_{AP}$ and $T17_{AP}$-$F23_{AP}$; (ii) and the needle eye, a β-turn comprising $D11_{AP}$-$T15_{AP}$. (The subscript $_{AP}$ indicates the sequence numbering in the antagonistic peptide (JBT1837).) The β-sheet is stabilized by a disulfide bridge ($C7_{AP}$ and $C18_{AP}$) and a hydrophobic zipper comprising the side chains of $Y3_{AP}$, $W5_{AP}$ and $W20_{AP}$.

Analyzing the interaction between KD1-KD2 and JBT1837 with the PISA server resulted in a total interaction surface of 1340 Å². More than ⅔ of the interaction surface consists of a hydrophobic anchor in JBT1837 interacting with residues spread over TFPI, including KD1, KD2, and the linker, as illustrated by an interaction matrix, a summary of which is provided in Table 18, and FIG. 74.

TABLE 18

| JBT 1837 | BSAA Å² | % | KD1 | LINKER | KD2 |
|---|---|---|---|---|---|
| Ser1 | 50.7 | 35 | C59, E60 | | |
| Tyr2 | 83.9 | 72 | R41, Y56 | | |
| Tyr3 | 11.7 | 12 | R65 | | |
| Lys4 | 48.0 | 72 | E67 | | E142 |
| Trp5 | 143.5 | 96 | Q63, M75 | I84 | |
| His6 | 83.9 | 89 | | | M134, F137, E142, I146 |
| Cys7 | 26.8 | 65 | E71 | | |
| Ala8 | 36.9 | 89 | | | M134, N136 |
| Met9 | 95.0 | 63 | | R83 | L131, G132, N133, M134 |
| Arg10 | 52.5 | 31 | | | L131 |
| Asp11 | 41.2 | 61 | | R83 | L131 |
| Met12 | 55.2 | 28 | | | C106, C130 |
| Lys13 | 34.7 | 19 | | N80 | |
| Gly14 | 17.2 | 57 | | | |
| Thr15 | 75.7 | 94 | K74 | N80, N82, R83 | |
| Met16 | 33.26 | 42 | | N82, R83 | |
| Thr17 | 71.5 | 89 | | R83, I85 | M134 |
| Cys18 | 60.9 | 100 | M75 | N82, R83, I84, I85 | |
| Val19 | 74.65 | 99 | | I85, T87 | F96, M134 |
| Trp20 | 89.4 | 68 | Q63, R65 | T87 | |
| Val 21 | 54.25 | 99 | | T87 | I146 |
| Lys22 | 37.1 | 27 | | | |
| Phe23 | 108.5 | 64 | | | N145, I146 |

In addition to the hydrophobic contacts, the matrix identifies polar interactions that stabilize the TFPI-JBT1837 complex, e.g., by hydrogen bonds between the side chain of $H6_{AP}$ with the carbonyl oxygen of M134 and NE of $W5_{AP}$ with the carbonyl oxygen of Q63, as well as a short β-strand comprising $M16_{AP}$-$C18_{AP}$ and R83-I85. Additionally Nζ of $K4_{AP}$ is equidistantly coordinated by the side chains of E67 and E142.

Beside its role in JBT1837 stabilization, the disulfide bridge of $C7_{AP}$-$C18_{AP}$ perfectly fits into a hydrophobic cavity formed by E71, M75, N82, and I84, thus playing a significant role in stabilizing the TFPI-JBT1837 complex.

Although TFPI is mainly conserved through different species, the key residues within the linker and KD2 (M134, I146) are only shared by close relatives to the human species (FIG. 74). Additionally, the A81V substitution in macaque destabilizes the β-turn of the linker by steric hindrance, impairing subsequent interaction of the linker with JBT1837.

KD1 of the previously solved KD1+JBT1857 complex was superimposed on the KD1-KD2+JBT1837 complex to provide a model of the arrangement of the ternary structure. The model suggested that JBT1837 and JBT1857 bind to opposing sites of KD1. The C-terminus of JBT1857 and the N-terminus of JBT1837 were 20 Å apart; thus, a linker moiety approximately 20 Å in length, corresponding to about 10 amino acids, would connect JBT1857 and JBT1837 and allow binding to the subunits respective binding sites on TFPI.

Figure 75:
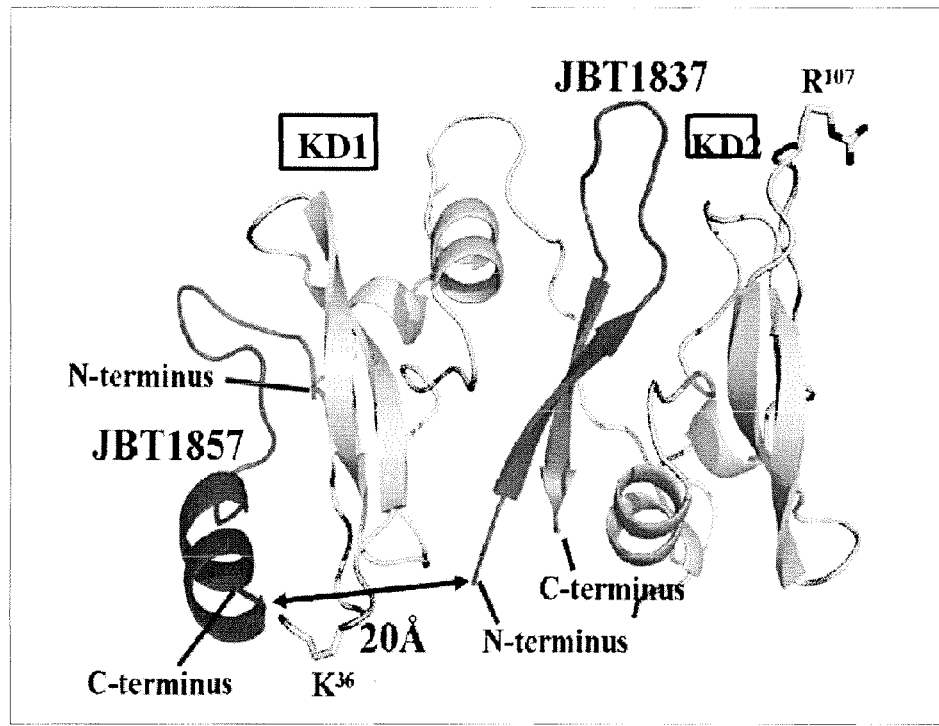
FIG. 75 is a ribbon structure of the a model of KD1-KD2 in complex with JBT1857 and JBT1837.

KD1-KD2+JBT1837+JBT1857 crystals belong to the tetragonal space group P $4_32_12$ and diffract to a maximum resolution of 2.7 Å. Screw axes were confirmed by axial extinctions and cell content analysis indicated a mass of 72 kDa in the asymmetric unit. Assuming that the ternary complex crystallized, this corresponds to either three (62 kDa; 61% solvens) or four (82 kDa; 46% solvens) copies in the asymmetric unit. However, the structure could not be completely solved, possibly due to the inherent flexibility of the KD1-KD2 molecule structure. Analysis of the interactions between TFPI and JBT1837, as well as the peptide-induced conformation of TFPI, suggests that JBT1837 may not bind to TFPI of species other than human. The high selectivity of JBT1837 is advantageous as it minimizes cross-reactivity and thus unwanted side effects. JBT1857 binds TFPI at a different site, and native PAGE demonstrated that both peptides can bind to TFPI at the same time. This analysis is further confirmed by a crystal structure-based model of KD1-KD2+JBT1837+JBT1857 (FIG. 75). The C-terminus of JBT1857 and the N-terminus of JBT1837 lie only 20 Å apart, and a linker of e.g., ten Ala (or Ser) would allow binding of both JBT1837 and JBT1857 to their binding sites within TFPI.

Example 16

The following example describes the characterization of a peptide complex that binds TFPI.

TFPI-binding peptides were produced as described herein. The peptides were synthesized as trifluoroacetate (TFA) salts with a purity >90%, and solved in DMSO to a stock concentration of 10 mM.

Figure 66A:
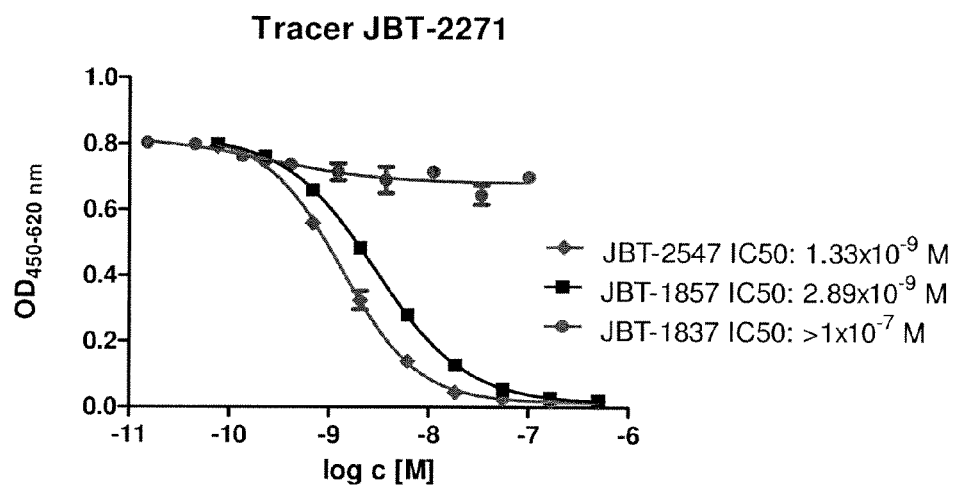
FIGS. 66A and 66B depicts $IC_{50}$ curves of TFPI-binding peptides JBT1837 (SEQ ID NO: 1044) and JBT1857 (SEQ ID NO: 178) and peptide complex JBT2547 (SEQ ID NO: 4260) using two tracers: JBT2271 (SEQ ID NO: 4033), a biotinylated derivative of JBT1857 (FIG. 66A), and JBT2316 (SEQ ID NO: 1313), a biotinylated derivative of JBT1837 (FIG. 66B).
Figure 66B:
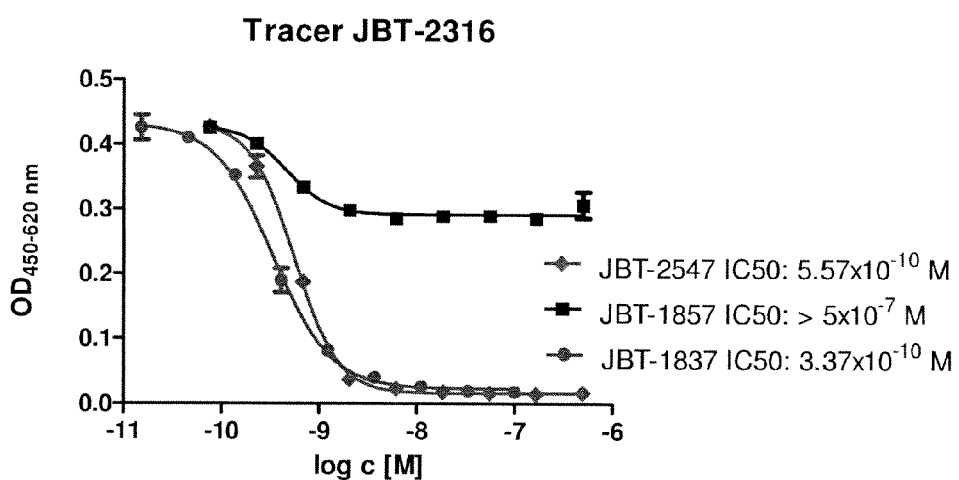

Competition ($IC_{50}$) ELISAs were performed using biotinylated TFPI-binding peptides as "tracers" to compete for TFPI-binding with non-biotinylated candidate peptides. The assay principle is depicted in FIG. 6B. Ninety-six well Maxisorp plates (Nunc) were coated with 0.05 μg/mL TFPI in coating buffer (15 mM $Na_2CO_3$, 35 mM $NaHCO_3$, pH 9.6) overnight. Plates were washed three times with 350 μl wash buffer (HNaT: 175 mM NaCl, 25 mM HEPES, 5 mM $CaCl_2$, 0.1% Tween 80, pH 7.35), and blocked with 200 μl 2% yeast extract in HNaT for two hours. Plates were then washed three times with 350 μl HNaT. Biotinylated tracer peptides were applied at a concentration corresponding to their respective $EC_{90}$ values determined in a binding ELISA (mean value if n>2). A competitor stock solution of candidate peptide (10 mM or prediluted in DMSO) was diluted 1/33.3 in HNaT, and a serial 1/3 dilution was prepared with HNaT with 3% DMSO. The dilution strategy employed in a particular assay was adjusted based on the affinity of the peptide. The dilution was further diluted with the biotinylated tracer peptide in a ratio of 1:6 (20 µl competitor dilution and 100 µl tracer peptide). The mixture of competitor and tracer peptide was applied to the TFPI-coated microtiter plate and incubated for 1.5 hours. The plates were washed three times with 350 µl HNaT. Peptide-TFPI binding was detected by applying horseradish peroxidase (HRP)-conjugated streptavidin to the microtiter plate, incubating the mixture for one hour, washing the plate three times with 350 µl HNaT, applying TMB (3,3'5, 5'-Tetramethylbenzidin), and detecting the subsequent chromogenic conversion of TMB by HRP. $IC_{50}$ graphs for the representative peptides JBT1857 (SEQ ID NO: 178), JBT1837 (SEQ ID NO: 1044) and the peptide complex JBT2547 (Ac-FQSKpNVHVDGYFERL-Aib-AKLSSSSSSSSSSSYYKWH[CAMRDMKGTMTC]VWVKF-NH2 (SEQ ID NO: 4260)) are depicted in FIGS. 66A and 66B.

The TFPI-inhibitory peptide complex JBT2547, comprising two different TFPI-binding peptides (JBT1857 and JBT1837) that bind two different sites within TFPI, demonstrated an $IC_{50}$ of $1.33\times10^{-9}$ M (Tracer JBT2271) and an $IC_{50}$ of $5.57\times10^{-10}$ M (tracer JBT2316), which was comparable or lower than the $IC_{50}$ of the peptide subunits.

Additionally, JBT2547 binding to full length TFPI was characterized in a surface plasmon resonance assay (BIAcore T200™, GE Healthcare, Chalfont St. Giles, UK). Recombinant, full length TFPI-1 was immobilized on a CMS chip aiming at 500 RU. Peptide was injected at a flow rate of 30 µL/minute at concentrations ranging from 1 to 16 nM in HBS-P buffer, pH 7.4, 0.1% DMSO. Subsequently, peptide was dissociated for 600 seconds. BIAcore T200™ Evaluation Software was utilized to analyze the data, which revealed that JBT2547 tightly binds full length TFPI with a binding constant <1 nM. The $K_D$ was calculated to be $7.49\times10^{-12}$ M.

Example 17

This example describes an exemplary method for characterizing the binding affinity of a TFPI-binding peptide complex using a $k_{off}$ assay.

Wells of a microtiter plate (96 wells, Maxisorp, Nunc) were coated with 1.6 nM TFPI in coating buffer (15 mM $Na_2CO_3$, 35 mM $NaHCO_3$, pH 9.3) for two hours at room temperature. The plate was then washed three times with 350 µl wash buffer (175 mM NaCl, 5 mM $CaCl_2$, 25 mM HEPES, 0.1% Tween 80, pH 7.35), and the wells were blocked with 100 µl blocking buffer (2% yeast extract, 175 mM NaCl, 5 mM $CaCl_2$, 25 mM HEPES, 0.1% Tween 80, pH 7.35). If an incubation period of 24 hours was employed, the wells were blocked for at least one hour. Control wells used for a 15 minute incubation period were blocked for additional 23.5 hours.

For a 24 hour incubation period, the wells were washed three times with 350 µl wash buffer and incubated with 50 µl test peptide (JBT2547 (SEQ ID NO: 4260) or JBT1857 (SEQ ID NO: 178)) in wash buffer. The concentration of test peptide was adjusted based on the individual $IC_{90}$ concentration determined in, e.g., the TFPI $IC_{50}$ ELISA assay described herein. The TFPI-coated wells were exposed to test peptide for approximately 15 minutes. The wells were subsequently washed three times with 350 µl wash buffer, and 50 µl tracer (competitor) peptide (JBT2271 (SEQ ID NO: 4033)) was added. Control wells (maximum signal) were incubated with tracer only. Blank wells lacking TFPI-coating were incubated with tracer only. Addition of the tracer peptide started the 24 hour incubation period.

A 15 minute incubation period was employed as a control if the $IC_{90}$ concentration of the test peptide led to a 90% reduction of the maximum signal. Wells blocked for an additional 23.5 hours were washed three times with 350 µl wash buffer to remove the blocking buffer. Subsequently, 50 µl analyte in wash buffer was added, and the wells were incubated for 15 minutes. The concentration of test peptide utilized was adjusted based on the peptide's $IC_{90}$ concentration determined using, e.g., a TFPI $IC_{50}$ ELISA assay. The 15 minute incubation was followed by three wash steps with 350 µl wash buffer and the addition of 50 µl tracer peptide. Control wells (maximum signal) were incubated with tracer only. Blank wells lacking TFPI also were incubated with tracer only.

The plate was washed three times with 350 µl wash buffer, and 50 µl HRP-conjugated streptavidin (R&D Systems, 1:200 in wash buffer) was added to each well. After an incubation period of one hour at room temperature, the plate was washed three times with wash buffer. TMB solution (50 µl per well; SeramunBlau fast, Seramun) was added. After a 1.5 minute incubation at room temperature, the reaction was stopped by the addition of 50 µl 1 M $H_2SO_4$ per well. Absorbance was measured using a photometer (Spectramax M5, Molecular Devices) at 450 nm and 620 nm.

Figure 67:
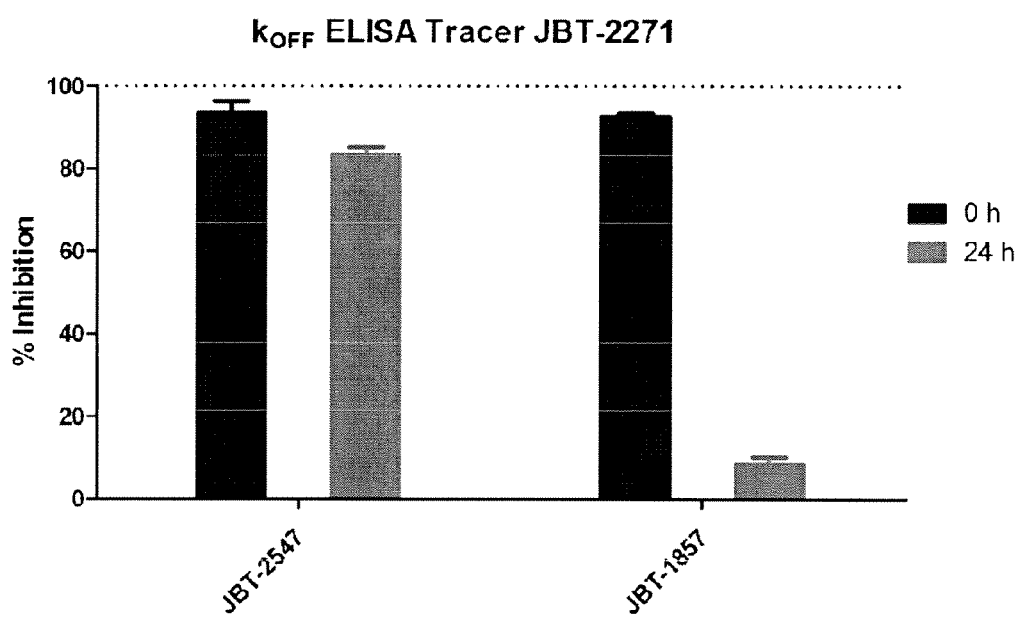
FIG. 67 is a bar graph illustrating the results of a $K_{off}$ assay with JBT2547 (SEQ ID NO: 4260) and JBT1857 (SEQ ID NO: 178) (X-axis) presented as % inhibition of TFPI binding by the tracer peptide, JBT2271 (SEQ ID NO: 4033) (Y-axis).

The assay results are presented in FIG. 67 as a percentage of the corrected optical density (OD450-OD620) of wells exposed to test peptide and tracer peptide in relation to TFPI-coated wells exposed only to tracer. After 24 hours, the TFPI-binding peptide complex continued to block binding of the tracer to TFPI. In contrast, JBT1857 dissociated from TFPI during the 24 hour incubation period. Thus, JBT2547 dissociated significantly slower from TFPI than one of its peptide subunit, JBT1857.

The affinity of JBT2528 for TFPI also was determined using the methods described herein: $K_D=1.6$ nM; $k_{on}=6.5\times 10^5$ 1/Ms; $k_{off}=9.7\times10^4$ 1/s. JBT2528 binds TFPI KD1.

Example 18

This example describes the plasma stability of the TFPI-binding peptide complex JBT-2547 in mouse and human plasma. JBT2547 (SEQ ID NO: 4260) and JBT1857 (SEQ ID NO: 178) were added to samples of mouse or human plasma and incubated for 24 hour at 37° C. The percentage of the initial amount of peptide remaining after incubation was determined by $IC_{50}$ ELISA on Maxisorp plates coated with 0.05 mg/ml TFPI (2.26 nM tracer peptide JBT2271). Less than 5% of the initial amount of JBT1857 remained in mouse plasma after the incubation period, while 15% of the initial amount of JBT-2547 remained after the same incubation period. Similarly, JBT2547 was more stable in human plasma compared to JBT1857 and JBT1837; 27% of the original amount of JBT1857 and 46% of JBT1837 remained after 24 hours while 54% of the original amount of JBT2547 was detected. Thus, the complex of JBT1857 and JBT1837 increased stability and resistance to plasma proteases. JBT2528 (Hex-FQSKp-C(Acm)-VH-Tle-DaYFERL-Aib-AKL-NH2 (SEQ ID NO: 4246)) also exhibited enhanced stability: 93% of the original amount of remained after 24 hours in human plasma, and 35% of the original amount of remained after 24 hours in mouse plasma.

Example 19

The following example describes the characterization of the TFPI-inhibitory activity of a TFPI-binding peptide complex and TFPI-binding peptide monomers using FXa inhibition and extrinsic tenase inhibition assays described in Example 3.

Peptides were diluted in 1.25× reaction buffer+0.1% Tween-80 (31.25 mM HEPES; 218.75 mM NaCl; 6.25 mM CaCl$_2$; 0.125% BSA; pH 7.35) from 1 or 10 mM stocks (in DMSO). TFPI, FVIIa, and lipidated TF were diluted in 1.25× reaction buffer. Phospholipid vesicles (DOPC/POPS 80/20) and chromogenic substrate specific for FXa (S-2222 (available from DiaPharma, West Chester, Ohio)), all diluted in Aqua dest., were added to 96-well plates. After an incubation period, TFPI and peptide dilutions were added. The TFPI concentration in the extrinsic tenase inhibition assay was 0.0625 nM. FX activation was initiated by adding FX to the wells. FXa-mediated chromogenic substrate conversion was determined by observing an increase in absorbance using a micro-plate reader. The amount of FXa generated at certain time points was calculated from the OD readings. FXa generated at 20 minutes after start of the reaction was considered for calculation of $EC_{50}$ from plots of peptide concentration versus the inhibition of TFPI (%).

The functional inhibition of TFPI also was examined using a FXa inhibition assay. A FXa-specific chromogenic substrate (S-2222) and phospholipid vesicles (DOPC/POPS 80/20), both diluted in Aqua dest., and TFPI proteins (full length human TFPI, human TFPI 1-160, murine TFPI 1-160, and cynomolgus TFPI 1-160) diluted in 1.25× reaction buffer, were added to 96 well plates. The TFPI concentration in the FXa inhibition assay was 0.5 nM. Peptides were diluted from 1 or 10 mM stocks (in DMSO) in 1.25× reaction buffer+0.1% Tween-80. The peptide dilutions (2.5 μl) were added to the 96 well plates. The conversion of chromogenic substrate was triggered by the addition of FXa, and the kinetics of the conversion was measured in a micro-plate reader. OD readings after 115 minutes were considered for calculation of the $EC_{50}$ from plots of peptide concentration versus the inhibition of TFPI.

Figure 68A:
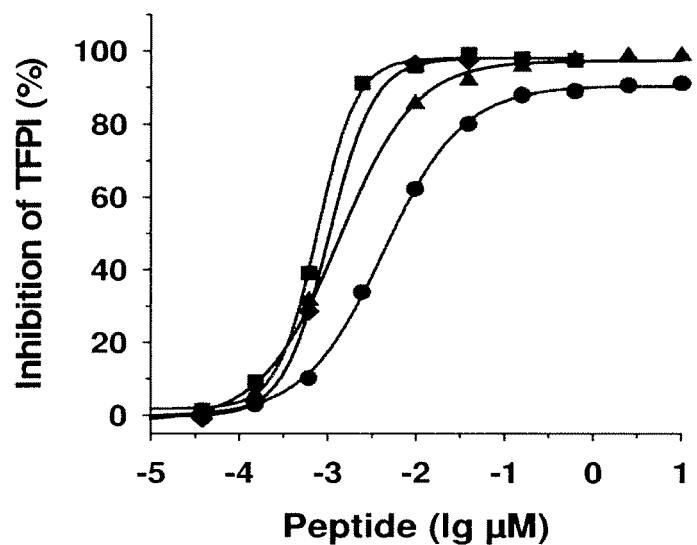
FIGS. 68A-F illustrate the results of FXa inhibition assays using a TFPI-binding peptide complex.
Figure 68B:
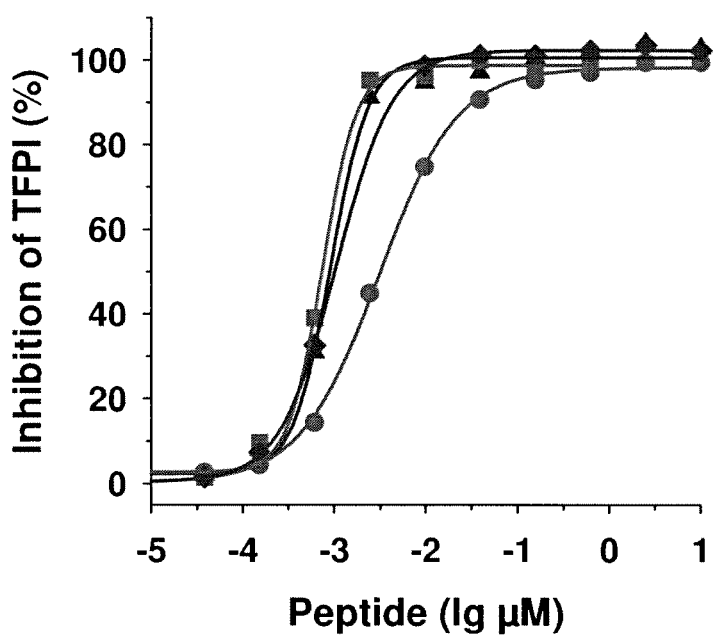

Results from the FXa inhibition assay and extrinsic tenase assay are provided in Table 19 and FIGS. 68A and 68B.

TABLE 19

| | FXa Inhibition Assay | | Extrinsic Tenase Assay | |
|---|---|---|---|---|
| | $EC_{50}$ [μM] | Maximal inhibition (%) | $EC_{50}$ [μM] | Maximal inhibition (%) |
| JBT1837 | 1.3 | 97 | 0.2 | 72 |
| JBT1857 | 4.3 | 90 | 8.8 | 59 |
| JBT2528 | 2.9 | 89 | 6.0 | 71 |
| JBT2547 | 1.0 | 98 | 0.3 | 99 |
| JBT1837 + JBT1857 | 0.8 | 98 | 0.3 | 84 |

JBT1837, JBT2547, JBT2528, and the combination of JBT1837 and JBT1857 very efficiently inhibited 0.5 nM full length and C-terminally truncated TFPI 1-160 (Table 19 and FIGS. 68A and 68B) in the FXa inhibition assay. JBT1857 less efficiently inhibited both TFPIs with $EC_{50}$s of 4.3 and 3.1 nM, respectively. At concentrations above 100 nM, JBT1837, JBT2547, and the combination of JBT1837 and JBT1857 fully blocked TFPI activity, as indicated by a nearly 100% maximal inhibition. JBT1857 (and JBT2528) is a partial inhibitor of TFPI and demonstrated some residual TFPI inhibitory activity at high and saturating concentrations. Inhibition of both full length and C-terminally truncated TFPIs confirms that binding epitopes of the peptides are within Kunitz Domains 1 and 2, and that the C-terminal region of TFPI is not required for efficient inhibition of TFPI activity.

The candidate peptides also were analyzed for inhibition of murine and cynomolgus monkey TFPI. C-terminally truncated murine and monkey TFPI proteins (TFPI 1-160) were used in a FXa inhibition assay performed as described herein. The results are summarized in Table 20 and FIGS. 68C and 68D.

TABLE 20

| FXa Inhibition Assay | Mouse TFPI 1-160 | | Cynomolgus Monkey TFPI 1-160 | |
|---|---|---|---|---|
| | $EC_{50}$ [μM] | Maximal inhibition (%) | $EC_{50}$ [μM] | Maximal inhibition (%) |
| JBT1837 | — | — | — | — |
| JBT1857 | 7.2 | 93 | 2060* | —* |
| JBT2547 | 3.1 | 85 | 10 | 100 |
| JBT1837 + JBT1857 | 7.0 | 89 | 100 | 89 |

*no maximum reached for fitting

Figure 68C:
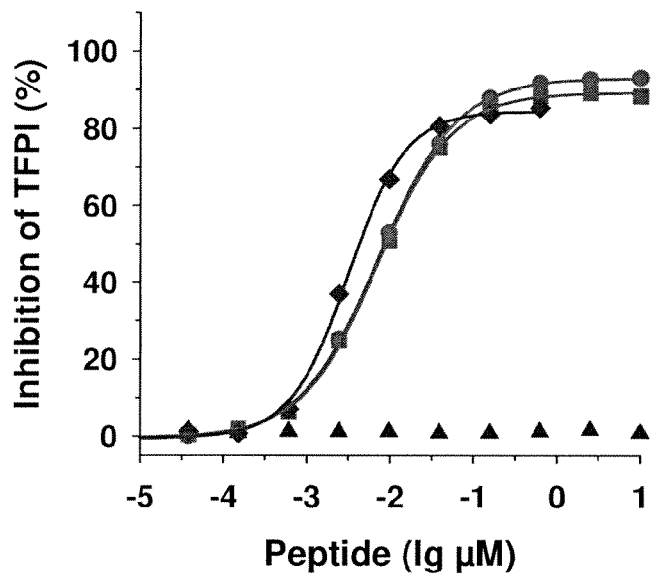
Figure 68D:
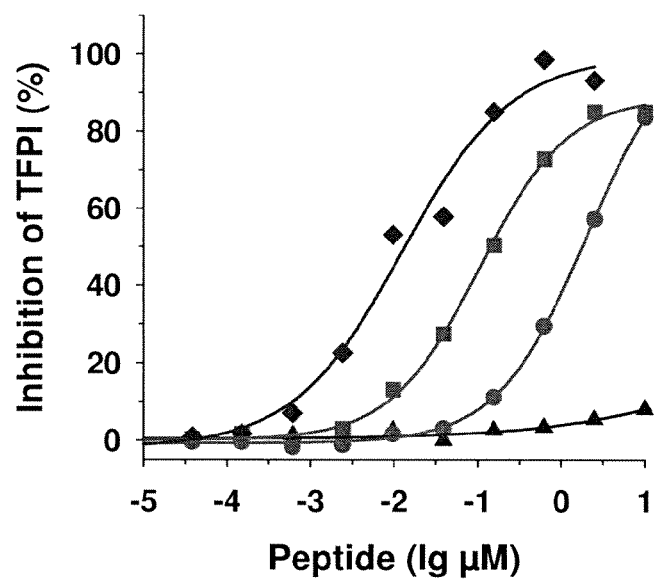

JBT1837 did not inhibit mouse TFPI 1-160 up to 10 μM (FIG. 68C). Cynomolgus monkey TFPI was only weakly inhibited at μM concentrations, likely due to inter-species sequence differences which are incompatible with binding of JBT1837 (FIG. 68D). JBT1857 efficiently inhibited mouse TFPI resulting in an $EC_{50}$ of 7.2 nM, which is comparable to inhibition of human TFPI. Cynomolgus monkey TFPI was inefficiently inhibited by JBT1857, likely due to an Ala to Pro substitution within the binding site of JBT1857.

JBT2547 most efficiently inhibited both mouse and cynomolgus monkey TFPI. JBT2547 mediated an approximately 200-fold and 10-fold greater reduction of $EC_{50}$s compared to JBT1857 and to the combination of JBT1837 and JBT1857. This further indicates that the molecular fusion of the two peptides entities increases its TFPI inhibitory activity.

Figure 68E:
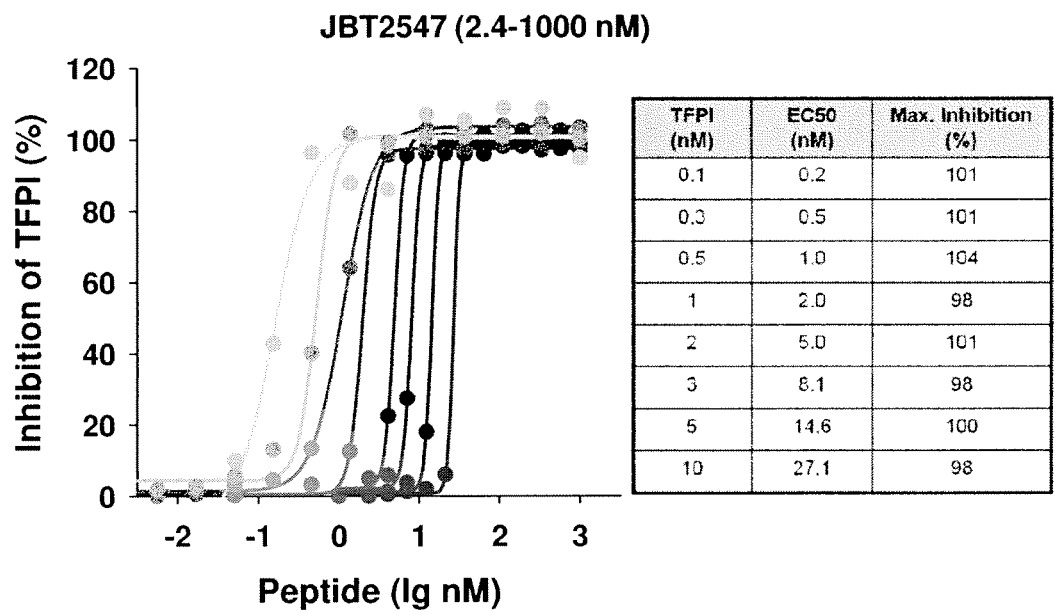
Figure 68F:
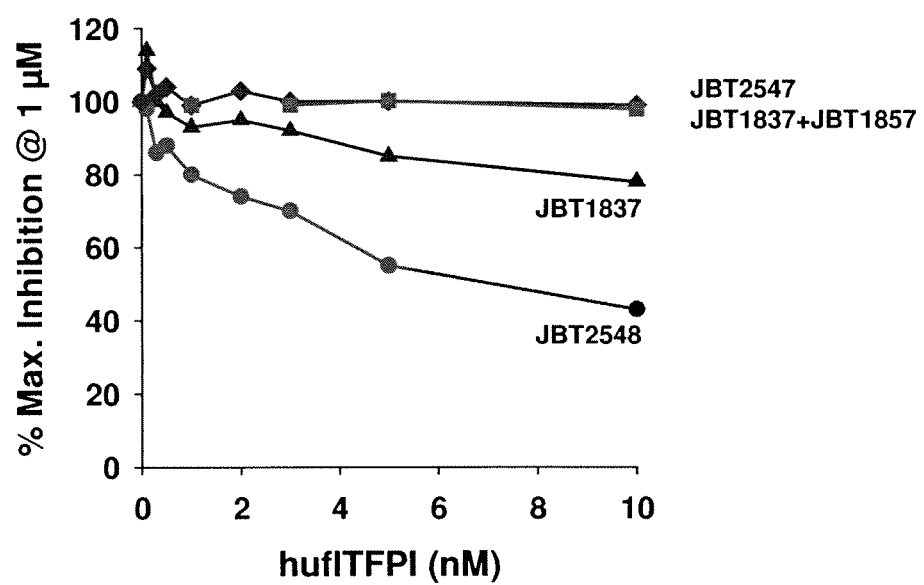

To demonstrate that the peptide complex efficiently inhibits high concentrations of TFPI, peptides were titrated at increasing human TFPI concentrations. JBT2547 stoichiometrically and fully (100%) inhibited TFPI activity at all concentrations tested (up to 10 nM) (FIGS. 68E and 68F). In contrast, peptides JBT1837 and JBT2548 (a derivative of JBT1857) are partial inhibitors of TFPI at high concentrations (FIG. 68D). Linking TFPI-inhibitory peptides to form a peptide complex enhances inhibition of TFPI activity.

Figure 69A:
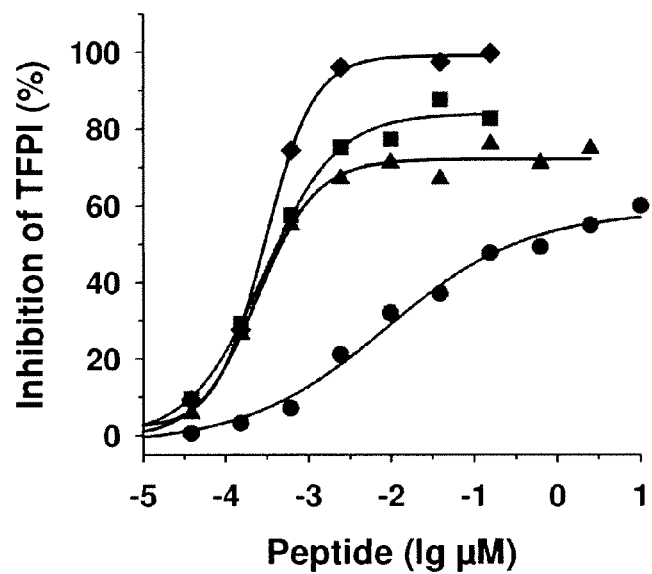
FIG. 69A is a graph correlating concentration of JBT1837 (triangles; SEQ ID NO: 1044), JBT1857 (circles; SEQ ID NO: 178), JBT2547 (diamonds; SEQ ID NO: 4260), and JBT1837+JBT1857 (squares) (μM) (X-axis) with percent inhibition of TFPI in an extrinsic tenase inhibition assay performed with 0.063 nM full length human TFPI.
Figure 69B:
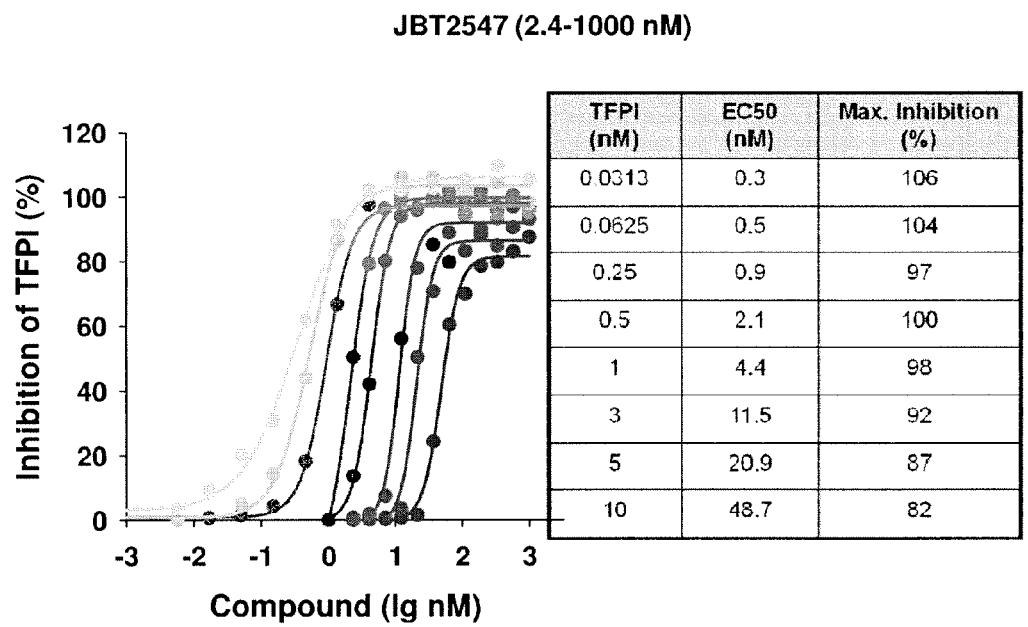
FIG. 69B illustrates TFPI inhibition by JBT2547 at increasing TFPI concentrations (0.031 to 10 nM from left to right) in an extrinsic tenase inhibition assay. Data points were fitted by a sigmoidal dose response equation resulting in $EC_{50}$s (nM) and maximal inhibition (%).
Figure 69C:
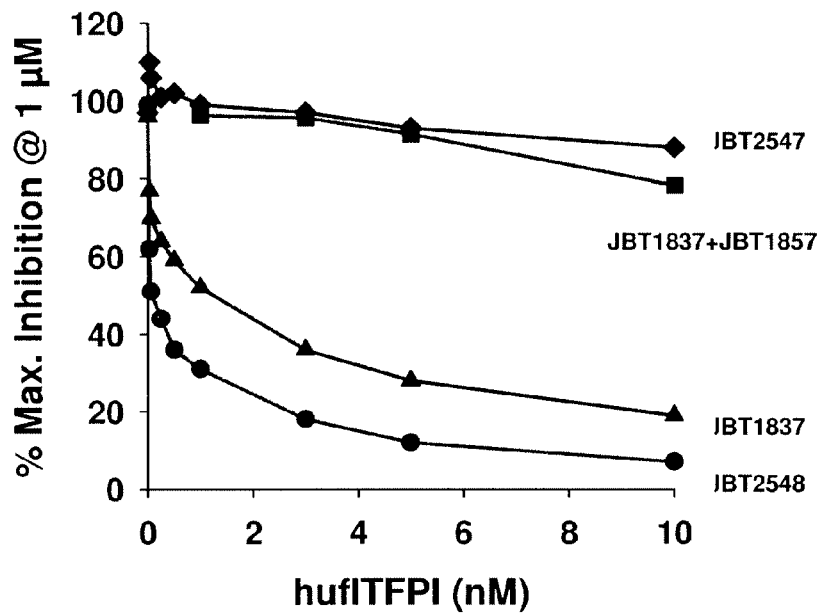
FIG. 69C is a graph correlating percent maximum inhibition of TFPI (Y-axis) mediated by JBT1837 (triangles; SEQ ID NO: 1044), JBT2548 (circles; SEQ ID NO: 4261), JBT2547 (diamonds; SEQ ID NO: 4260), and JBT1837+ JBT1857 (squares) (1 µM) with concentration of full length human TFPI used in the extrinsic tenase inhibition assay.
Figure 69D:
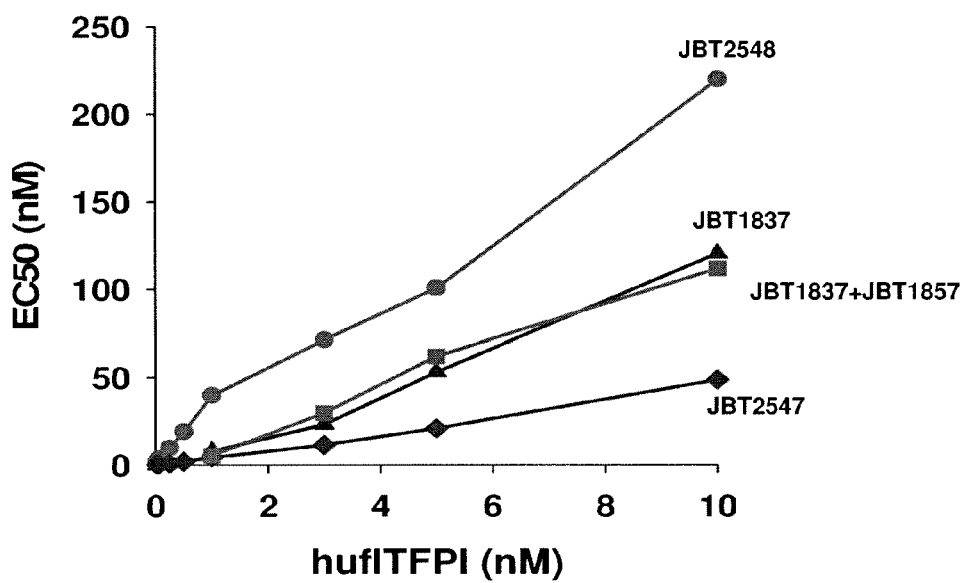
FIG. 69D is a graph correlating $EC_{50}$ of JBT1837 (triangles; SEQ ID NO: 1044), JBT2548 (circles; SEQ ID NO: 4261), JBT2547 (diamonds); SEQ ID NO: 4260, and JBT1837+ JBT1857 (squares) (1 µM) with concentration (nM) of full length human TFPI used in the extrinsic tenase inhibition assay. $EC_{50}$s were calculated by fitting of peptide concentrations response at increasing TFPI concentrations vs. full length TFPI concentrations.

In the extrinsic tenase assay, JBT2547 restored extrinsic complex-mediated FX activation in the presence of TFPI with an $EC_{50}$ of 0.3 nM, resulting in nearly 100% inhibition of TFPI activity at low TFPI concentration (0.063 nM). JBT1837, JBT1857 and the combination of JBT1837+JBT1857 less efficiently inhibited TFPI, as indicated by higher $EC_{50}$ and reduced maximal inhibition (FIG. 69A). To demonstrate that the peptide complex efficiently inhibits high concentrations of TFPI, JBT2547 was titrated at increasing TFPI concentrations. JBT2547 efficiently inhibited TFPI activity at all concentrations tested (up to 10 nM) with lowest $EC_{50}$s of the peptides tested (FIGS. 69B-69D). In contrast, peptides JBT1837, JBT2548, and the combination of peptides JBT1837+JBT1857 partially inhibited TFPI at high concentrations (FIGS. 69C-69D) with higher $EC_{50}$ compared to JBT2547.

TFPI antagonist activities of JBT1837, JBT1857, a mixture of JBT1837 and JBT1857, and JBT2547 also was determined in reactions systems in which FXa was inhibited by TFPI in the presence of $Ca^{2+}$, phospholipid (PL)+$Ca^{2+}$, and PL+$Ca^{2+}$+protein S. The effectivity by which the peptides block the activity of TFPI increases in the order JBT1857, JBT1837, the mixture of JBT1837 and JBT1857, and JBT2547. JBT1837 and JBT1857 did not completely block TFPI, particularly not in the presence of cofactor protein S. A mixture of JBT1837 and JBT1857 was more potent as TFPI antagonist than the individual peptides. The fusion peptide JBT2547 was by far the best TFPI antagonist; at a concentration of 50 nM the peptide complex almost completely blocked TFPI even in the presence of PL+$Ca^{2+}$+protein S.

This example demonstrates that the linkage of two TFPI-binding peptides of the invention by, e.g., molecular fusion, improves TFPI inhibitory activity. JBT1837 prevents the formation of the primary TFPI-FXa complex (encounter complex) and at high concentrations can fully block TFPI inhibition of FXa. JBT1857 prevents the transition of the weak encounter to the tight TFPI-FXa complex and partially inhibits TFPI since in the presence of JBT1857 it is still possible to form the primary TFPI-FXa complex (encounter complex). A molecular fusion of the two TFPI binding peptides demonstrated a great degree of inhibitory activity than each peptide alone and a mixture of the peptide subunits (i.e., the effect was greater than additive).

Example 20

In this example, the TFPI inhibitory activity of a TFPI-binding peptide complex is characterized using the plasma-based assay of Example 4. TFPI-binding peptides were tested under physiological conditions (~0.2 nM full length TFPI) as well conditions mimicking elevated full length TFPI plasma levels (up to 10 nM full length TFPI).

The influence of peptides on thrombin generation in the absence or in the presence of exogenous flTFPI was measured in duplicate via calibrated automated thrombography in a Fluoroskan Ascent® reader (Thermo Labsystems, Helsinki, Finland; filters 390 nm excitation and 460 nm emission) following the slow cleavage of a thrombin-specific fluorogenic substrate (Hemker, Pathophysiol. *Haemost. Thromb.*, 33, 4-15 (2003)). As a model for antibody-mediated FVIII deficiency, frozen pooled normal plasma (George King Bio-Medical Inc., Overland Park, KN) was incubated with high titer, heat inactivated, anti-human FVIII plasma raised in goat (4490 BU/ml; Baxter BioScience, Vienna, Austria) giving rise to 50 BU/mL. Assays were also performed with cynomolgus monkey and marmoset monkey plasma. The plasmas were mixed with corn trypsin inhibitor (CTI) (Hematologic Technologies, Inc., Essex Junction, Vt.) to inhibit Factor XIIa contamination, resulting in a final concentration of 40 µg/mL.

Pre-warmed (37° C.) plasma (80 µL) was added to each well of a 96 well micro-plate (Immulon 2HB, clear U-bottom; Thermo Electron, Waltham, Mass.). To trigger thrombin generation by Tissue Factor, 10 µL of PPP low reagent containing recombinant human Tissue Factor (12 µM) and phospholipid vesicles composed of phosphatidylserine, phosphatidylcholine and phosphatidylethanolamine (48 µM) (Thrombinoscope BV, Maastricht, The Netherlands) were added. Just prior to putting the plate into the pre-warmed (37° C.) reader, 5 µL of peptide solutions were added, resulting in plasma concentrations of 1-100 nM. Finally, 5 µL HEPES buffered saline with 5 mg/mL bovine serum albumin (Sigma-Aldrich Corporation, St. Louis, Mo., USA) or 5 µL full length TFPI (flTFPI) dilution were added. The flTFPI protein (3557 nM) had been expressed in SK Hep cells and purified. Plasma concentrations of flTFPI varied between 0.31 and 10 nM, which is equivalent to a ~2 to 50-fold increase in endogenous flTFPI plasma concentration. Thrombin generation was initiated by addition of 20 µL of FluCa reagent (Thrombinoscope BV, Maastricht, The Netherlands) containing a fluorogenic substrate and HEPES-buffered $CaCl_2$ (100 mM). Fluorescence intensity was recorded at 37° C. The parameters of the resulting thrombin generation curves were calculated using Thrombinoscope™ software (Thrombinoscope BV, Maastricht, The Netherlands) and thrombin calibrator to correct for inner filter and substrate consumption effects (Hemker, *Pathophysiol. Haemost. Thromb.*, 33, 4-15 (2003)). The final plasma dilution, TF concentration, and assay temperature for the human plasma assay was 1:1.5, 1 pM, and 37° C., respectively. The final plasma dilution, TF concentration, and assay temperature for the mouse C57B16 plasma assay and mouse FVII–/– plasma assay was 1:2.4, 0.4 pM, and 33° C. respectively. The final plasma dilution, TF concentration, and assay temperature for the cynomolgous and marmoset monkey plasma assays was 1:1.5, 0.6 pM, and 37° C. respectively.

Representative results for improvement of thrombin generation of human FVIII inhibited plasma are provided in Table 21.

TABLE 21

|  | $EC_{50}$ (nM) | Maximal improvement of thrombin generation relative to an inhibitory polyclonal anti TFPI antibody (%) |
|---|---|---|
| JBT1834 | 4.8 | 55.9 |
| JBT1857 | 6.8 | 37.0 |
| JBT1837 + JBT1857 | 7.4 | 104.6 |
| JBT2547 | 7.8 | 112.7 |

JBT1837, JBT1857, a mixture of JBT1837+JBT1857, and the complex of JBT1837 and JBT1857 (JBT2547) improved thrombin generation of FVIII-inhibited plasma with similar $EC_{50}$s. The maximal efficacy relative to a polyclonal anti-TFPI antibody was highest for JBT2547, demonstrating that fusion of two TFPI-binding peptides described herein enhances inhibition of TFPI activity in plasma.

Figure 70A:
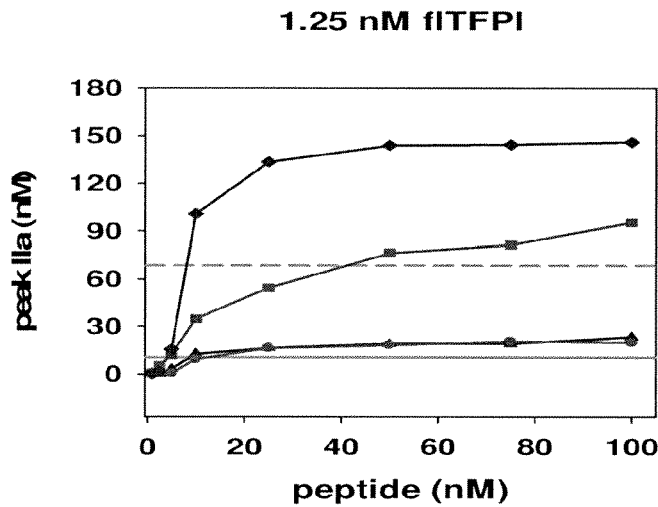
FIGS. 70A-70C illustrate the results of a thrombin generation assay performed in FVIII-inhibited plasma. The figures correlate peak Factor IIa (thrombin) generation (nM) (Y-axis) with the concentration (nM) of JBT1837 (triangle), JBT1857 (circle), a combination of JBT1837+JBT1857 (square), and JBT2547 (diamond) (X-axis) in the presence of 1.25 nM flTFPI (FIG. 70A), 3.75 nM flTFPI (FIG. 70B), and 10 nM flTFPI (FIG. 70C). Dotted line—pooled normal plasma (PNP); solid line-FVIII-inhibited plasma (PNP+aFVIII).
Figure 70B:
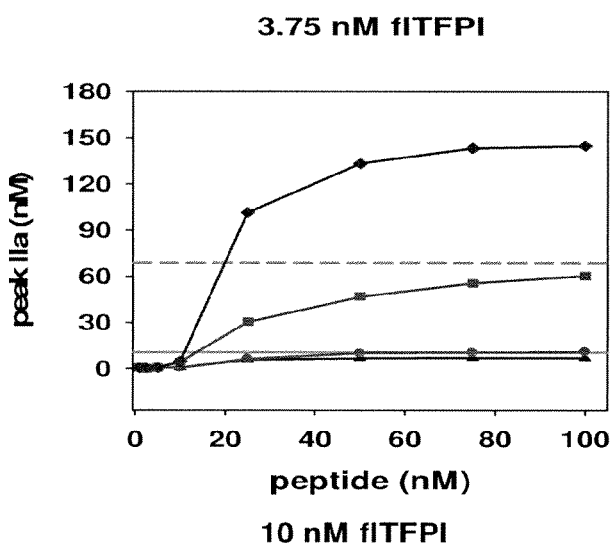
Figure 70C:
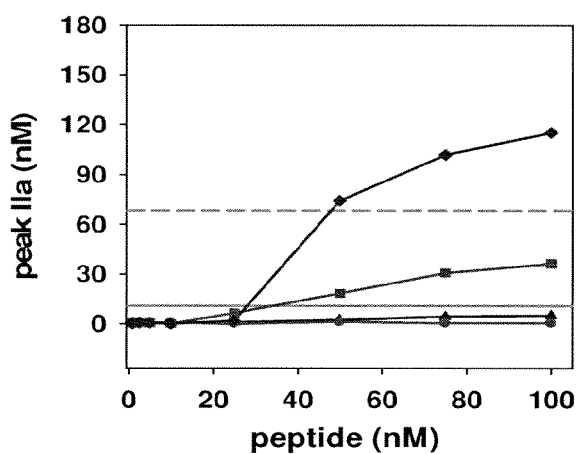

FIGS. 70A-70C illustrate the inhibitory activity of 1-100 nM of the fusion peptide JBT2547 (diamond) toward elevated levels of flTFPI plasma levels (1.25, 3.75 and 10 nM) in the thrombin generation assay. In comparison with JBT1837 (triangle) and JBT1857 (circle), JBT2547 shows a substantially greater ability to increase the thrombin peak even in the presence of very high flTFPI plasma levels. Although combining JBT1837 and JBT1857 (square) improved the response over each monomeric peptide alone, the combination of monomers did not achieve the level of activation achieved by the peptide complex. The TFPI-antagonistic potential of JBT2547 also was tested in the presence of a wide concentration range of flTFPI of up to 10 nM, which is equivalent to 50-fold higher than physiological flTFPI plasma concentration. Concentrations of 50-100 nM JBT2547 fully compensated the anticoagulant effect of 10 nM flTFPI, and thrombin peak values reached normal plasma levels or above. JBT2547 concentrations below 50 nM improved thrombin generation of FVIII-inhibited plasma in a flTFPI-dependent manner.

The results of thrombin generation experiments with several animal plasmas are summarized in Tables 22 and 23.

TABLE 22

|  | Mouse C57Bl6 plasma | | Mouse FVIII knock out | |
|---|---|---|---|---|
|  | $EC_{50}$ [nM] | Maximal inhibition (%) | $EC_{50}$ [µM] | Maximal inhibition (%) |
| JBT1837 | No binding | No binding | No binding | No binding |
| JBT1857 | 64.1 | 115.8 | 55.1 | 134.4 |
| JBT2547 | 41.0 | 109.3 | 56.7 | 138.3 |

TABLE 22-continued

|  | Mouse C57Bl6 plasma | | Mouse FVIII knock out | |
| --- | --- | --- | --- | --- |
|  | $EC_{50}$ [nM] | Maximal inhibition (%) | $EC_{50}$ [µM] | Maximal inhibition (%) |
| JBT1837 + JBT1857 | 52.7 | 104.7 | 61.1 | 144.0 |

TABLE 23

|  | $EC_{50}$ [nM]; Cynomologus Monkey | $EC_{50}$ [µM]; Marmoset Plasma |
| --- | --- | --- |
| JBT1837 | — | No binding |
| JBT1857 | 1003.7 | 35.1 |
| JBT2547 | — | 38.4 |
| JBT1837 + JBT1857 | — | 34.8 |

* "—" indicates no curve fit

JBT1837 did not inhibit mouse and marmoset monkey TFPI at relevant concentrations. Cynomolgus monkey TFPI is a poorly inhibited only at µM concentrations. JBT1857 efficiently inhibited mouse and marmoset monkey TFPIs, whereas cynomolgus monkey TFPI was less efficiently inhibited by JBT1857, likely due to an Ala to Pro amino acid substitution within the binding site of JBT1857 which is conserved as an Ala in human, mouse and marmoset monkey TFPI. Cynomolgus monkey TFPI is most efficiently inhibited by the fusion peptide JBT2547.

Example 21

Figure 71A:
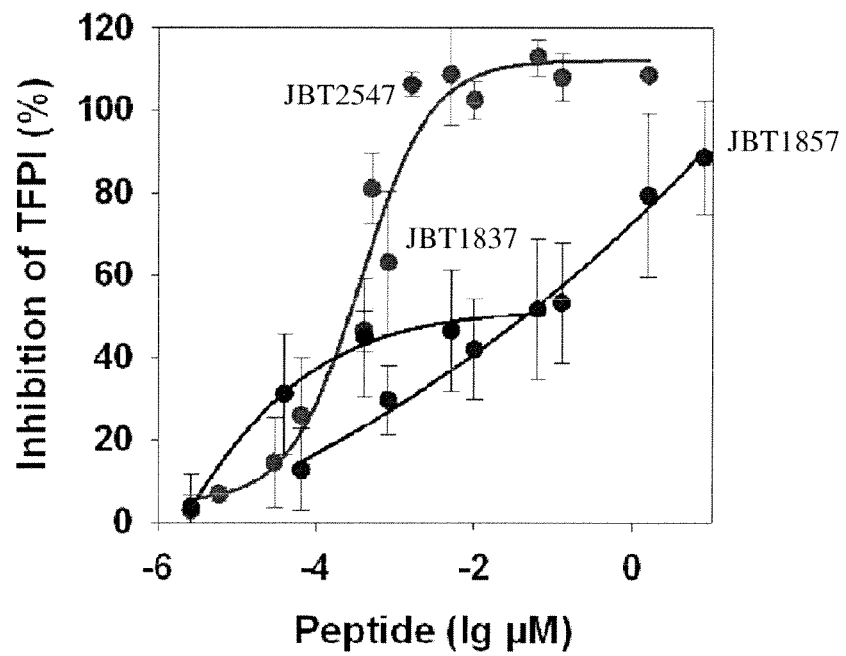
FIG. 71A-71B are graphs correlating percent inhibition of TFPI (Y-axis) achieved at various concentrations (X-axis) of JBT2547, JBT1837, and 1857 (FIG. 71A) or JBT2547 (diamonds), JBT1837 (triangles), JBT1837+JBT1857 (squares), and JBT2548 (circles) (FIG. 71B) in a cell-based extrinsic tenase assay.
Figure 71B:
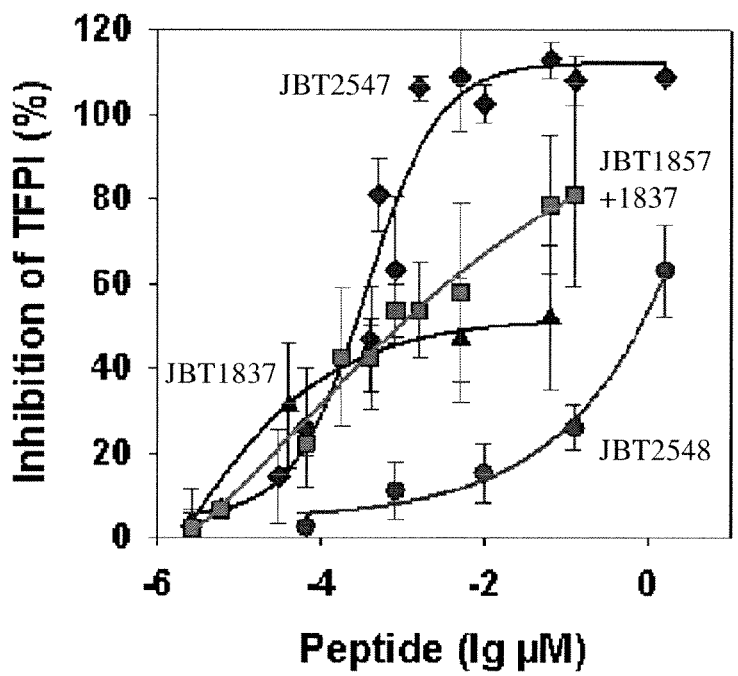

This example describes the ability of the TFPI-binding peptides described above to restore extrinsic tenase complex-mediated conversion of FX to FXa in a cell-based extrinsic tenase assay. The assay was performed as described in Example 5. FXa concentrations obtained after nine minutes of reaction in the presence of 100 nM polyclonal anti-human TFPI antibody (R&D Systems, AF2974) were set to 100%, and the samples that were not exposed to antibody were set to 0% TFPI inhibitory effect, allowing for assessment of peptide's inhibitory activity. The results of the assay are illustrated in FIGS. 71A and 71B. JBT2547 demonstrated improved inhibition of HUVEC TFPI compared to JBT1837, JBT1857, JBT2548, and a mixture of JBT1857 and JBT1837. Full inhibition of TFPI was achieved at concentrations as low as about 10 nM.

Example 22

This example describes a method for assessing clot formation in whole blood using rotation thromboelastography (ROTEM). The assay was performed as described in Example 8. The analytical set-up was as follows: 300 µL of pre-warmed (37° C.) CTI treated citrated whole blood was added to a peptide sample (10, 100, 1000 nM final assay concentration) or a control, followed by addition of a 1:15 dilution of TF PRP reagent containing recombinant human tissue factor (rTF, 3 pM) (TS40, Thrombinoscope BV, Maastricht, The Netherlands). In certain experiments, exogenous full length TFPI (flTFPI) at final concentrations of 2 or 10 nM was added to simulate flTFPI plasma levels of up to 50-fold over normal. Coagulation was initiated by the addition of 20 µL 200 mM $CaCl_2$ (star-TEM®, Pentapharm, Munich, Germany) and recordings were allowed to proceed for at least 120 min. The final concentration of rTF in the assay was 44 fM. The thromboelastographic parameters of clotting time (CT), clot formation time (CFT) and maximum clot firmness (MCF) were recorded in accordance with the manufacturer's instructions. CT is defined as the time from the start of measurement to the start of clot formation. CFT is defined as the time from the start of clot formation until an amplitude of 20 mm is reached. MCF is the maximum difference in amplitude between the two traces during the assay.

Figure 72A:
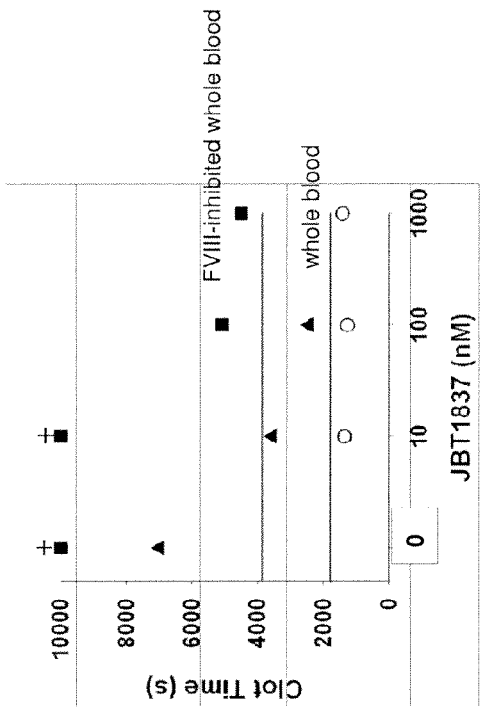
FIGS. 72A-72C illustrate the procoagulant effect of increasing concentrations (10, 100, 1000 nM) of JBT2547 (FIG. 72A), JBT1837 (FIG. 72B), or JBT1857 (FIG. 72C) in FVIII-inhibited whole blood in absence of additional external human full length TFPI (open circles) and presence of increasing amounts of external full length TFPI (2 nM, closed triangles; 10 nM, closed squares). Clot times of FVIII-inhibited whole blood and normal whole blood are given as reference. +=no clot time achieved.
Figure 72B:
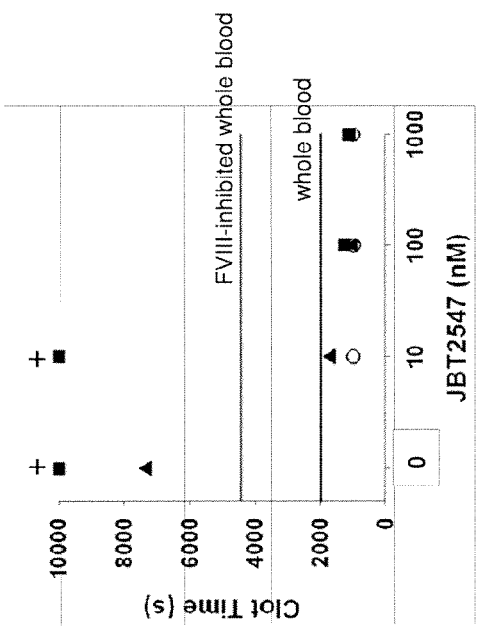
Figure 72C:
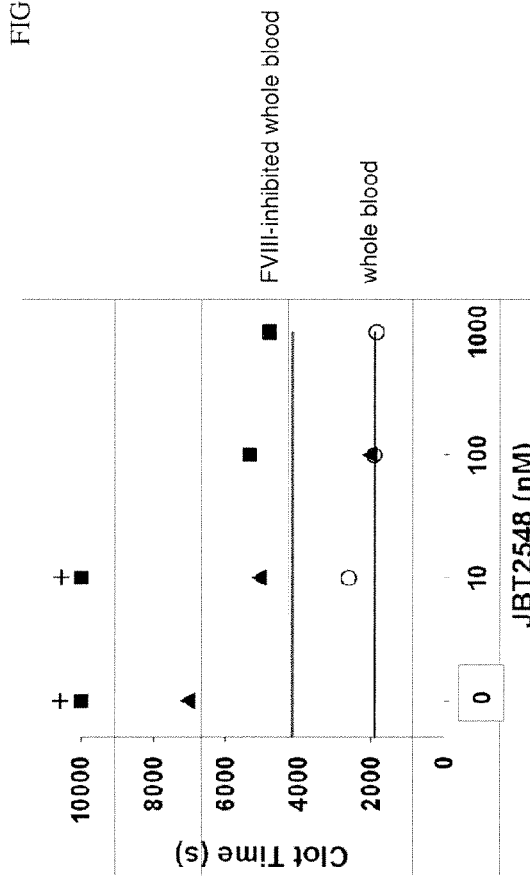

Addition of full length TFPI to FVIII-inhibited whole blood in the absence of TFPI inhibitory peptides substantially inhibited coagulation as indicated by a marked increased in clot time (FIGS. 72A-72C). JBT2528 and JBT1837 improved global hemostatic parameters of FVIII-inhibited plasma ($EC_{50}$=11 nM and 4 nM, respectively). JBT1837 and JBT2548 improved coagulation by reducing the clot time to normal levels in a concentration dependent manner (FIGS. 72B and 72C; open circles). These peptides failed to reach clot times of FVIII-inhibited blood at increased TFPI concentrations (e.g., 10 nM). In contrast, concentrations of JBT2547 above 100 nM fully restored normal coagulation of FVIII-inhibited whole blood to which 2 nM and 10 nM full length TFPI was added.

This example further confirms that TFPI-binding peptide complexes efficiently neutralize TFPI and restore normal coagulation even at increased TFPI concentrations.

Example 23

Platelets contain full length TFPI, which is released to plasma upon platelet activation and results in a platelet TFPI concentration in plasma that approximates 50-75% of the full length TFPI in plasma at sites of injury. This example demonstrates inhibition of platelet TFPI by peptides of the invention.

Blood Collection and Plasma Preparation:

Blood samples were collected from a number of different donors. Nine volumes of venous blood was drawn by venipuncture into 1 volume of 1.09 tri-sodium citrate with or without 500 µg/ml CTI and centrifuged at 250×g for 15 minutes for the preparation of platelet-rich plasma (PRP) or at 2860×g for the preparation of platelet-poor plasma (PPP). PPP was aliquoted, snap-frozen and stored at −80° C. until use. In experiments in which a normal plasma pool (NP) was used, blood collected from more than 25 healthy individuals was centrifuged at 2000×g for 15 minutes to separate plasma from blood cells, and again at 11000×g for 5 min to obtain platelet-poor plasma.

Platelet Isolation:

Blood (45 ml) was collected on 7.5 ml acid citrate/dextrose (ACD, 80 mM trisodium citrate, 52 mM citric acid, 183 mM glucose) and centrifuged during 15 min at 248×g. To remove residual erythrocytes, the supernatant (platelet rich plasma, PRP) was centrifuged for an additional 5 minutes at 248×g. The PRP was subsequently centrifuged during 15 minutes at 2760 rpm (1360×g) to spin down the platelets. The platelet pellet was washed twice by resuspending in 20 ml (first wash) and 15 ml (second wash) platelet buffer (10 mM HEPES, 136 mM NaCl, 2.7 mM KCl, 2.0 mM $MgCl_2$, 0.5% bovine serum albumin and 0.2% glucose, pH 6.6), followed by centrifugation during 15 minutes at 2760 rpm (1360×g). After the second wash step, the platelets were resuspended in 3.5 ml platelet buffer (pH 7.5) and the platelet concentration was determined in a Coulter counter. Finally, the platelet suspension was diluted to the required platelet concentration by dilution with platelet buffer (pH 7.5) and 40 µl of a 25 mg/ml solution of the synthetic peptide Arg-Gly-Asp-Ser (RGDS)

was added per 3.5 ml platelet suspension to inhibit platelet aggregation during storage at room temperature.

Functional Characterization of Platelet TFPI:

TFPI was released from isolated platelets by activating the platelets at 37° C. during 15 min with 100 ng/ml convulxin. The platelets were spun down by centrifugation (15 min at 2800×g) in an Eppendorf centrifuge tube, and the supernatant was collected as source of platelet TFPI. Platelet TFPI was quantified with a full length TFPI ELISA using recombinant TFPI as standard. The functional activity of platelet TFPI was compared to the activity of recombinant TFPI in two assay systems: 1) inhibition of FVIIa-catalysed FX activation in a model system and 2) inhibition of thrombin generation in TFPI-deficient plasma.

In the model system assay, the effect of varying concentrations recombinant or platelet TFPI on TF-FVIIa catalysed FX activation was determined at 37° C. in a 25 mM HEPES (pH 7.7), 175 mM NaCl, 5 mg/ml bovine serum albumin (BSA) buffer containing 2 pM FVIIa, 5 nM TF, 100 nM FX, and 400 uM Fluophen FXa. In this assay FVIIa, TF, TFPI and Fluophen FXa were preincubated for 7 minutes at 37° C. in the HEPES buffer and FX activation was initiated by adding FX. Progress curves of fluophen FXa conversion by the FXa generated were determined in Fluoroskan Ascent® reader (Thermo Labsystems, Helsinki, Finland) and corrected for consumption of Fluophen FXa and so-called inner filter effects (Udenfriend S, *Fluorescence Assay in Biology and Medicine*. New York, Academic Press, 1996, vol 1, pp 13, 118, vol 2, pp 182-185) by the methodology that is also used for the correction of thrombin generation curves for substrate consumption (Hemker et al., *Pathophysiol Haemost Thromb*, 32, 249-53 (2002)). Time courses of FXa generation and the effects of TFPI thereon were obtained by taking the first derivative of the corrected progress curves of Fluophen FXa conversion. Alternatively, the effect of TFPI on TF-FVIIa-catalysed FX activation was also followed with a FXa-specific chromogenic substrate, e.g., 125 µM CS-11(65).

In the thrombin generation assay, TFPI-depleted plasma was reconstituted with varying amounts of recombinant TFPI or platelet-derived TFPI, and thrombin generation was determined using the Calibrated Automated Thrombogram (CAT) method described by Hemker et al., supra. Thrombin generation was initiated in plasma by addition of varying concentrations of recombinant TF (0.1-10 pM), 16 mM $CaCl_2$, 30 µM phospholipid vesicles (1,2-dioleoyl-sn-glycero-3-phosphoserine/1,2-dioleoyl-sn-glycero-3-phosphoethanolamine/1,2-dioleoyl-sn-glycero-3-phosphatidylcholine, 20/20/60, M/M/M) and 30-50 µg/ml corn trypsin inhibitor (CTI). In experiments in PRP, no phospholipid vesicles were added to the plasma. The thrombin activity in plasma was monitored continuously with the fluorogenic substrate Z-Gly-Gly-Arg-AMC (BACHEM, Bubendorf, Switzerland). Fluorescence was read in a Fluoroskan Ascent® reader (Thermo Labsystems, Helsinki, Finland) and thrombin generation curves were calculated using Thrombinoscope™ software (Thrombinoscope, Maastricht, The Netherlands).

Analysis of the Effect of Peptides of the Invention on Recombinant-, Plasma-, and platelet TFPI:

The effects of TFPI binding peptides on the anticoagulant activity of TFPI was tested in model systems (inhibition of FXa and TF-FVIIa-catalysed FX activation by TFPI) and in plasma (NP, PPP, PRP or TFPI-depleted plasma reconstituted with recombinant- or platelet-TFPI or platelets). The effect of peptides on the inhibition of FXa by TFPI was followed in a HNBSA buffer (50 mM HEPES pH 7.7, 175 mM NaCl, 5 mg/mL BSA) containing 125 µM CS-11(65), 1 mM EDTA or 3 mM $CaCl_2$ and, if present, varying concentrations of peptide and TFPI, 80 nM protein S and/or 30 µM phospholipid vesicles (20:60:20 DOPS/DOPC/DOPE), which was preincubated for 10 minutes at 37° C. hFXa was added and the increase in absorbance at 405 nm was followed in an Ultra Microplate Reader (Bio-Tek, Burlington, Vt., USA) until a steady state rate of chromogenic substrate conversion was achieved (~60 min). Progress curves of chromogenic substrate conversion were fitted to the integrated rate equation for slow-tight binding inhibition (Huang et al., *J Biol Chem*, 268, 26950-55 (1993)):

$$A_t = A_0 + (v_s \cdot t) + (v_0 - v_s) \cdot (1 - \exp(-k_{obs} \cdot t))/k_{obs}$$

in which $A_t$ is absorbance at 405 nm at time t; $A_0$ is initial absorbance at 405 nm; $v_s$ is final steady-state velocity; $v_0$ is initial velocity; $k_{obs}$ is apparent rate constant for the transition from $v_0$ to $v_s$ (FXa-TFPI to FXa-TFPI*). The values $v_0$ and $v_s$ relative to rates of chromogenic substrate conversion by FXa in the absence of TFPI, represent the extent of loose and tight FXa-TFPI complex formation.

The effect of peptides on the inhibition of TF-FVIIa-catalysed FX activation by TFPI was determined at 37° C. in a 25 mM HEPES (pH 7.7), 175 mM NaCl, 5 mg/ml bovine serum albumin (BSA) buffer containing 2 pM FVIIa, 5 nM TF, 100 nM FX, 400 µM Fluophen FXa and varying amounts of peptide and TFPI (recombinant- or platelet-derived). In this assay FVIIa, TF, TFPI, peptide, and Fluophen FXa were preincubated for 7 minutes at 37° C. in the HEPES buffer, and FX activation was initiated by adding FX. Progress curves of Fluophen FXa conversion by the FXa generated were determined in Fluoroskan Ascent® reader (Thermo Labsystems, Helsinki, Finland) and corrected for consumption of Fluophen FXa and so-called inner filter effects by the methodology that is also used for the correction of thrombin generation curves for substrate. The time courses of FXa generation and the effects of TFPI thereon were obtained by taking the first derivative of the corrected progress curves of Fluophen FXa conversion. Alternatively, the effect of TFPI on TF-FVIIa-catalysed FX activation was also followed with a FXa-specific chromogenic substrate e.g. 125 µM CS-11(65).

The effect of peptides on plasma- and platelet TFPI was assessed by measuring their effects on thrombin generation determined as described below in NP, PPP, PRP or in TFPI-depleted plasma reconstituted with recombinant- or platelet-TFPI or platelets. In experiments in PRP or in TFPI-depleted plasma reconstituted with platelets, the platelets were either not-activated or activated with 80 ng/ml convulxin or 40 ug/ml Horm collagen (final concentrations in the well). To simulate haemophilia plasma, thrombin generation experiments were performed in the presence of a goat inhibitor plasma of which 1 µl was added to 80 µl plasma to neutralize FVIII.

In thrombin generation experiments, the plasma was added to the microtiter plate and, if present, mixed with proper amounts of phospholipids, platelets, TFPI, anti-FVIII, anti-TFPI antibodies, peptide and incubated for 7 minutes at 37° C. After this preincubation, TF and platelets activator (if present) were added immediately, followed by a mixture fluorogenic substrate/$CaCl_2$ mixture (FluCa) which initiates thrombin generation.

Results:

The platelet supernatant TFPI inhibited TF-FVIIa-catalysed FX inactivation in a concentration-dependent manner. The inhibition by platelet supernatant was prevented by a cocktail of anti-TFPI antibodies, which underscores that it was TFPI in the platelet supernatant that is the inhibitor of TF-FVIIa-catalysed FX activation. However, rates of FX activation in the presence of platelet supernatant and anti-TFPI were higher than the rate of FX activation without platelet supernatant, suggesting that the platelet supernatant contained a small amount of a FX activator, e.g., FVIIa. This suggests that the data is an underestimation of the platelet TFPI concentration due to the fact that more FVIIa has to be inhibited when platelet supernatant is present in the assay mixture than in the assay mixture in which the calibration curve is made with recombinant TFPI in buffer.

The functional activity of platelet TFPI was also tested in TFPI-deficient plasma and compared to the activity of the recombinant non-glycosylated TFPI. The concentrations of platelet TFPI from different donors were determined with an ELISA in which the recombinant non-glycosylated TFPI was used as calibrator. Although no titrations were made with the different TFPI preparations in TFPI-deficient plasma, inspection of the effects of platelet- and recombinant TFPI on thrombin generation showed that, on a concentration basis, platelet and recombinant TFPI exhibit similar anticoagulant activities.

JBT1837, JBT1857, JBT1837+JBT1857, and JBT2547 (50 nM) blocked the ability of platelet TFPI to inhibit TF-FVIIa-catalysed FX activation. The fusion peptide was most effective and completely blocked the anticoagulant activity of TFPI. JBT1857 was the least effective followed by JBT1837 and the mixture of JBT1837 and JBT1857. Titration with JBT2547 demonstrated that a concentration of 10 nM almost completely inhibited the activity of platelet TFPI.

An additional study was performed to further elucidate the effects of plasma- and platelet-TFPI on the inhibition of thrombin generation in platelet-rich plasma (PRP) and platelet-poor plasma (PPP). To discriminate between the down-regulation of thrombin generation by platelet TFPI and plasma-derived TFPI, experiments were performed in TFPI-depleted plasma supplemented with platelets (source of platelet TFPI) and/or varying amounts of added purified TFPI (simulating variation of plasma TFPI levels). A preliminary experiment in TFPI-depleted plasma supplemented with convulxin-activated platelets showed that anti-TFPI antibodies enhanced thrombin generation, which indicated that TFPI released from the platelets inhibits thrombin generation.

It appeared that thrombin generation in PRP required TF. In PRP without CTI and in PRP to which CTI was added later, the ETP and thrombin peak height were hardly affected by the TF concentration (TF was not required) and only the lag time was shortened at increasing TF. When PRP was prepared from blood that was collected in citrate plus CTI, both the lag time and the thrombin peak were affected by TF concentration, indicating that experiments performed in PRP require that blood has to be collected in CTI.

In the experiments described above, the plasma was pre-activated with convulxin to promote the release of platelet TFPI before initiating thrombin generation with TF plus $Ca^{2+}$. Since convulxin is not a physiological trigger, a comparison of thrombin generation in PRP with non-activated platelets and platelets pre-activated with convulxin, collagen and Ca-ionophore was performed. It appeared that the thrombin-generating capacity of the platelets increased in the order no activator=ionophore<collagen<convulxin.

Additionally, in the experiments described above, the platelets were preincubated with activator (pre-activated) for 7 minutes in the presence of TF, and thrombin generation was initiated with a fluorogenic substrate/$Ca^{2+}$ mixture. When the platelet activator convulxin is added to the PRP 10-15 seconds before initiating thrombin generation with the fluorogenic substrate/$Ca^{2+}$ mixture, substantially less thrombin is generated than in PRP in which the platelets were pre-activated with convulxin before thrombin generation was started.

In view of these results, future studies will not include platelet pre-activation, and collagen or no activator will be primarily used in experiments in PRP.

The effects of TFPI antagonists were initially tested in PRP prepared from blood collected on CTI. Thrombin generation triggered in PRP with 0.1 pM TF+collagen was substantially enhanced by both an anti-TFPI cocktail and JBT2547. This shows that TFPI is a major regulator of thrombin generation on platelets, and that JBT2547 is as effective as an anti-TFPI cocktail in neutralizing the anticoagulant activity of TFPI. TFPI hardly down-regulated thrombin generation in PRP triggered with a high amount (10 pM) of TF.

The major part of the thrombin generated in PRP at low TF (1 pM) appeared be formed via the intrinsic Xase and, thus, requires FVIII. Both JBT2547 and an anti-TFPI cocktail substantially increased thrombin generation in PRP in which FVIII was neutralized with anti-FVIII, a condition representative for hemophilia plasma. JBT2547 also enhanced thrombin generation in TFPI-depleted plasma supplemented with platelets that were not activated or that were activated with collagen.

The experiments with JBT2547 were carried out with 4 µM peptide, which, considering the affinity of JBT2547 for TFPI (sub-nM range), likely is a large excess. Indeed, both in PPP and in PRP, 5-10 nM JBT2547 was sufficient to fully inhibit TFPI.

To test whether TFPI in plasma, either plasma- or platelet-derived, is fully inhibited by the TFPI antibody cocktail or JBT2547, a TFPI titration was performed in PPP and in PRP in the absence and presence of a TFPI antibody cocktail. Increasing TFPI concentrations on top of the TFPI that is present in plasma plus what is released from platelets gradually inhibited thrombin generation. In the presence of an TFPI antibody cocktail, all thrombin generation curves were the same, indicating that the TFPI antibody cocktail is not a partial TFPI inhibitor but fully neutralizes TFPI.

In PPP, low concentrations of TFPI added (0.05-0.5 nM) substantially inhibited thrombin generation and plots of thrombin generation parameters (log lag time or ln ETP) as a function of total TFPI (plasma TFPI+added TFPI) could be fitted to a straight line assuming that plasma contained ~0.3 nM TFPI. This indicated that the anticoagulant activity of added TFPI is similar to that of the TFPI that is present in plasma. In PRP, much larger amounts of added TFPI were required to inhibit thrombin generation.

The peptide complex JBT2547 enhanced thrombin generation 3-4-fold in PPP with an effective concentration ($EC_{50}$) of 2 nM and enhanced thrombin generation 2-fold in PRP with an $EC_{50}$ of 8 nM. Thrombin generation in PRP to which an inhibitory FVIII antibody was added to simulate PRP of a hemophilia patient was enhanced 3-fold by the peptide complex. The data described herein establish that peptides of the invention bind plasma-derived, recombinant, and platelet-derived TFPI, and enhance thrombin generation by blocking the anticoagulant effects of platelet and plasma-TFPI.

Example 24

This example describes the hemostatic effect of peptides of the invention in a murine model of hemophilic joint bleeding.

The goal of the study was to evaluate the effect of an exemplary PEGylated peptide of the invention on puncture-induced hemarthrosis in a murine model of hemophilia A. Peptide JBT2329 was administered at a dose of 1 mg/kg to FVIII-deficient mice with severe hemophilia (E16 FVIII B6; 129S4-F8$^{tm\ 1\ kaz}$/J) via intravenous tail vein injection. Various doses of recombinant FVIII (ADVATE; 10, 50, and 100

IU/kg) also were administered alone or in combination with JBT2329. After each product administration, the right knee joint capsule was punctured with a 30 gauge needle to induce hemorrhage. Animals were sacrificed three days following injury, and bleeding was assessed via gross and histological methods. The animal model and methods of evaluating bleeding are further described in Hakobyan et al., *Haemophilia*, 14, 804-809 (2008). Summary bleeding scores (SBS), which include visual and histological bleeding scores, were assigned to each joint. Administration of a PEGylated peptide of the invention prior to injury significantly reduced joint bleeding. The protective effect of 1 mg/kg of JBT2329 was significantly greater than the effect of 10 IU/kg ADVATE, but less than 100 IU/kg ADVATE, as determined by SBS. There was no significant difference in the protective effect conferred by 1 mg/kg JBT2329 and 50 IU/kg ADVATE. The results described herein further confirm that peptides of the invention provide a prophylactic or protective effect against bleeding in an in vivo model of hemophilia A.

Example 25

This example describes the impact of peptides of the invention on TFPI's ability to bind receptors that mediate clearance and cellular degradation. The pharmacokinetics of peptide-bound TFPI also is described.

The binding full length TFPI (fl-TFPI) to low density lipoprotein receptor-related protein (LRP) was studied using a BIAcore T200™ surface plasmon resonance assay (GE Healthcare, Chalfont St. Giles, UK) at 37° C. LRP was biotinylated using a biotinylation kit according to the manufacturer's protocol (Thermo Scientific). Following Neutravidin immobilization (2500 RU) to a Series S Sensor chip C1 (GE Healthcare) using standard amine coupling chemistry according to manufacturer's protocols, biotinylated recombinant human LRP-1 Cluster II Fc Chimera protein (R&D Systems) was bound to the surface via biotin-NeutrAvidin interactions resulting in 450 RUs. Following immobilization, fl-TFPI was injected at a flow rate of 30 µL/min in a single concentration of 10 nM diluted in running buffer (HBS-N, 0.1% P80, 5 mM $CaCl_2$). fl-TFPI was subsequently dissociated by changing the flow to running buffer conditions. When interaction of fl-TFPI and LRP was studied in the presence of peptides (JBT1837, JBT1857, JBT2329 (JBT1857+40 kD PEG), or JBT2547 (JBT1837+JBT1857)) or polyethylene glycol (40 kD), 1 µM final concentration of the peptide or PEG was added to fl-TFPI.

TFPI interacted efficiently with immobilized LRP with fast on- and off-rates. Truncated TFPI lacking kunitz domain 3 (KD3) and the C-terminus does not interact with LRP. By visual inspection, it was apparent that fl-TFPI bound to JBT1837, JBT1857 or JBT2329 still interacts with LRP. TFPI complexed to the fusion peptide JBT2547 resulted in a higher response than that observed for TFPI complexed with single peptides. The unchanged association and dissociation kinetics of the LRP-fl-TFPI interaction in the presence and absence of a peptide complex (JBT2547) suggests that differing results are associated with the increased molecular weight of the fl-TFPI-JBT2547 complex and potential simultaneous binding of LRP and peptide to fl-TFPI by JBT2547. A slight decrease in fl-TFPI LRP interaction was observed when TFPI was bound to JBT2329 (PEGylated JBT1857), whereas a 40 kD PEG alone does not influence the assay system, suggesting that a highly hydrated PEG-linked peptide slightly interferes with fl-TFPI LRP interaction.

TFPI interaction with asialoglycoprotein receptor (ASGPR) also was evaluated using a BIAcore 3000™ surface plasmon resonance assay (GE Healthcare, Chalfont St. Giles, UK) at 25° C. Following immobilization of ASGPR (Novus Biologicals, 470 RU) to a Series S Sensor chip CM5 (GE Healthcare) using standard amine coupling chemistry according to manufacturer's protocols, fl-TFPI was injected at a flow rate of 30 µL/min in the single cycle analysis mode at concentrations ranging from 3.84 nM to 150 nM diluted in running buffer (HBS pH 7.4, 0.1% P80, 5 mM $CaCl_2$). fl-TFPI was subsequently dissociated by changing the flow to running buffer conditions. When interaction of fl-TFPI and ASGPR was studied in the presence of JBT1837, JBT1857, JBT2329, or JBT2547, 1 µM final concentration of peptide was added to the fl-TFPI.

Fl-TFPI interacted efficiently with immobilized ASGPR with fast on- and off-rates. C-terminally truncated TFPI does not interact with ASGPR. It was apparent from visual inspection that fl-TFPI bound to JBT1857 or JBT2547 interacted with ASGPR. Like LRP, TFPI complexed to the fusion peptide JBT2547 generated in a higher response. Also similar to the interaction of fl-TFPI to LRP, JBT2329 diminished the ASGPR-fl-TFPI interaction, whereas a 40 kDa PEG alone did not influence the assay system. The data suggests that highly hydrated PEG-linked peptides of the invention interfere with TFPI-ASGPR interaction via steric hindrance.

To study the impact of TFPI-binding peptides on the pharmacokinetics of TFPI in vivo, groups of mice (C57B16, male, 20-25 g) were treated with either human fl-TFPI (775 nM, 5 mL/kg, i.v.), human fl-TFPI complexed to a 10-fold molar excess of JBT2528 (775 nM hu fl-TFPI, 7752 nM JBT2528, 5 mL/kg, i.v.) or human fl-TFPI complexed to a 10-fold molar excess of JBT2534 (775 nM hu fl-TFPI, 7752 nM JBT2534, 5 mL/kg, i.v.). JBT2528 has the same peptide sequence as JBT2534, but lacks the 40 kD PEG-modification. As such, JBT2528 serves as a control for a possible impact of PEGylation in the assay. At various time points, three mice were sacrificed, blood was taken by heart puncture, and plasma was isolated and stored frozen (<−60° C.) for further analysis. The sampling time points were as follows: fl-TFPI, 0.5, 1, 2 minutes; fl-TFPI-JBT2528, 0.5, 1, 2, 3, 5, 8 minutes; and fl-TFPI-JBT2534, 1, 2, 5, 10, 20, 35 minutes.

Plasma samples were analyzed for human TFPI with an ELISA which is specific for human TFPI. For quantification, wells of a microtiter plate (Nunc Maxisorp) were coated with 1 µg/mL of a monoclonal anti-human KD2 specific TFPI antibody (Sanquin, White label; MW1845) overnight at 4° C., followed by three wash cycles with TBS containing 0.1% Tween 20 (TBST). Wells were blocked for 1 hour at room temperature with TBS containing 2% non-fat dry milk (Bio-Rad). 100 µL of diluted sample were applied to the wells and incubated for 2 hours at room temperature. After washing with TBST (5×), wells were incubated for 1 hour with 0.5 µg/mL of a polyclonal rabbit anti hTFPI antibody (ADG72; American Diagnostica), washed 5× with TBST, and incubated further for 1 hour with 0.2 µg/mL of a goat anti rabbit HRP labelled antibody (A0545; Sigma). Color was developed by addition of 100 µL of substrate (SureBlue TMP, KLP) and stopping with 50 µL of 1 M HCl. Absorbance at 450 nm was measured with a microtiter plate reader (Thermo Appliskan Reader). Purified endogenous fl-TFPI, expressed by SKHep cells, was used as standard protein at concentrations of 0.25-16 ng/ml for quantification (Baxter Innovations GmbH). Plasma samples were diluted from 1/20 to 1/800 depending on the expected human TFPI concentration.

Human fl-TFPI had a very short half-life and very poor in vivo recovery. At the earliest time point (0.5 min), only one tenth of the expected TFPI level was observed. The recovery and the half-life of fl-TFPI remained unchanged when fl- TFPI was complexed with the tested peptides. This experiment indicates that PEGylation of a TFPI-binding peptide likely does not confer a longer half-life to fl-TFPI and does not affect TFPI clearance.

This example demonstrates that representative peptides of the invention do not significantly diminish TFPI interaction with clearance receptors and do not increase the half life of TFPI in vivo.

Example 26

This example demonstrates the ability of peptides of the invention to inhibit proteolytic degradation of TFPI.

TFPI is proteolytically inactivated by several enzymes, including elastase, thrombin, plasmin, FXa, and chymase. See, e.g., Hamuro et al., *FEBS Journal*, 274, 3056-3077 (2007). The impact of fusion protein JBT2547, as well as the individual peptide subunits JBT1837 and JBT1857, on the proteolytic degradation of fl-TFPI by neutrophil elastase was studied. Neutrophil elastase is a representative protease cleaving TFPI within Lys86 and Gln90 located between the Kunitz 1 and Kunitz 2 domains.

For proteolytic digest of fl-TFPI, 5 nM fl-TFPI were incubated with 5 nM neutrophil elastase (purified from human neutrophils, Calbiochem) in a reaction buffer (50 mM Tris, 300 mM NaCl, 10 mM CaCl$_2$, pH 7.5) at 37° C. The reaction was performed with and without 1 μM JBT1837, JBT1857, or JBT2547. Proteolysis was monitored by Western blot analysis. Aliquots were taken from the reaction mixture after 0, 5, 15, 30, and 60 minutes and immediately heated at 96° C. for 5 minutes in SDS-loading buffer at reducing conditions. Samples were separated on a 4-20% Tris-glycine SDS-polyacrylamide gel, and the proteins were transferred to a PVDF membrane. After blocking the membrane with non-fat dry milk, TFPI proteins were detected with a rabbit polyclonal antibody against human TFPI (AF2974, R&D Systems) and a secondary anti-rabbit-HRP conjugated antibody (Sigma). SuperSignal West Femto chemiluminescent substrate (Thermo Scientific) was applied to develop a chemiluminescent signal that was captured on film. The developed bands were quantified by densitometry.

In the absence of peptides, gradual degradation of fl-TFPI by neutrophil elastase was observed within 1 hour. The ~43 kD band visualized in the Western Blot corresponding to intact fl-TFPI almost completely disappeared, while two cleavage products were formed by cleavage of the peptide bond T87-T88. When JBT2547 was present, the proteolysis of fl-TFPI was blocked during the monitored time, indicating that JBT2547 protects fl-TFPI from degradation by elastase in vitro. The individual peptide subunits mediated different effects on fl-TFPI cleavage. JBT1837 protected fl-TFPI from proteolysis for one hour, similar to the results observed for JBT2547. In contrast, JBT1857 had only a minor or no effect on elastase cleavage.

SEQUENCE LISTING (4268 sequences)

SEQ ID NO: 1 - protein, 18 aa, Artificial Sequence
  Synthetic peptide
QSKKNVFVFGYFERLRAK

SEQ ID NO: 2 - protein, 20 aa, Artificial Sequence
  Synthetic peptide
  MOD_RES (1)..(1): Xaa is selected from the group consisting of Val, Trp, Tyr, and Phe
  MOD_RES (2)..(2): Xaa is selected from the group consisting of Asp, Gln, and Ser
  MOD_RES (3)..(3): Xaa is selected from the group consisting of Glu, Thr, Asn, and Ser
  MOD_RES (5)..(5): Xaa is selected from the group consisting of Leu, Pro, Lys, Ser, Trp, Val, Asn and Gln
  MOD_RES (9)..(9): Xaa is selected from the group consisting of Leu, Trp, Val, Ala, Met, Thr, and Ser
  MOD_RES (10)..(10): Xaa is selected from the group consisting of Thr, Phe, Val, Arg, Ala, Asp, Leu, Glu, Ser, and Tyr
  MOD_RES (13)..(13): Xaa is selected from the group consisting of Asn, Pro, Phe, His, Lys, and Tyr
  MOD_RES (14)..(14): Xaa is selected from the group consisting of Met, Asp, Glu, Val, Gly, and Lys
  MOD_RES (20)..(20): Xaa is selected from the group consisting of Gln, Ile, Gly, Trp, Arg, Leu, and Asn
XXXKXNVFXXGYXXRLRAKX

SEQ ID NO: 3 - protein, 25 aa, Artificial Sequence
  Synthetic peptide
TFVDERLLYFLTIGNMGMYAAQLKF

SEQ ID NO: 4 - protein, 18 aa, Artificial Sequence
  Synthetic peptide
VIVFTFRHNKLIGYERRY

SEQ ID NO: 5 - protein, 27 aa, Artificial Sequence
  Synthetic peptide
GVWQTHPRYFWTMWPDIKGEVIVLFGT

SEQ ID NO: 6 - protein, 20 aa, Artificial Sequence
  Synthetic peptide
KWFCGMRDMKGTMSCVWVKF

SEQ ID NO: 7 - protein, 19 aa, Artificial Sequence
  Synthetic peptide
ASFPLAVQLHVSKRSKEMA

SEQ ID NO: 8 - protein, 35 aa, Artificial Sequence
  Synthetic peptide
  MOD_RES (1)..(1): N-terminal acetylation
  MOD_RES (35)..(35): C-terminal amidation
KKSGVGRLQVAFQSKKNVFVFGYFERLRAKLTSKK

SEQ ID NO: 9 - protein, 32 aa, Artificial Sequence
  Synthetic peptide
  MOD_RES (1)..(1): N-terminal acetylation
  MOD_RES (32)..(32): C-terminal amidation
KKSGVGRLQVAFQSKKNVFVFGYFERLRAKKK

SEQ ID NO: 10 - protein, 32 aa, Artificial Sequence
  Synthetic peptide
  MOD_RES (1)..(1): N-terminal acetylation
  MOD_RES (32)..(32): C-terminal amidation
KKGRLQVAFQSKKNVFVFGYFERLRAKLTSKK

SEQ ID NO: 11 - protein, 29 aa, Artificial Sequence
  Synthetic peptide
  MOD_RES (1)..(1): N-terminal acetylation
  MOD_RES (29)..(29): C-terminal amidation
KKQVAFQSKKNVFVFGYFERLRAKLTSKK

SEQ ID NO: 12 - protein, 26 aa, Artificial Sequence
  Synthetic peptide
  MOD_RES (1)..(1): N-terminal acetylation
  MOD_RES (26)..(26): C-terminal amidation
KKFQSKKNVFVFGYFERLRAKLTSKK

SEQ ID NO: 13 - protein, 24 aa, Artificial Sequence
  Synthetic peptide
  MOD_RES (1)..(1): N-terminal acetylation
  MOD_RES (24)..(24): C-terminal amidation
KKFQSKKNVFVFGYFERLRAKLKK

SEQ ID NO: 14 - protein, 25 aa, Artificial Sequence
  Synthetic peptide
  MOD_RES (1)..(1): N-terminal acetylation
  MOD_RES (25)..(25): C-terminal amidation
KKAFQSKKNVFVFGYFERLRAKLKK

SEQ ID NO: 15 - protein, 36 aa, Artificial Sequence
  Synthetic peptide
  MOD_RES (1)..(1): N-terminal acetylation
  MOD_RES (2)..(2): Xaa is Carboxyfluorescein
  MOD_RES (36)..(36): C-terminal amidation
KXKSGVGRLQVAFQSKKNVFVFGYFERLRAKLTSKK

SEQ ID NO: 16 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFDRLRAKL

SEQ ID NO: 17 - protein, 20 aa, Artificial Sequence
  Synthetic peptide
  MOD_RES (1)..(1): N-terminal acetylation
  MOD_RES (20)..(20): C-terminal amidation
FQSKNNVFVQGYFDRLRAKL

SEQ ID NO: 18 - protein, 20 aa, Artificial Sequence
  Synthetic peptide
  MOD_RES (1)..(1): N-terminal acetylation
  MOD_RES (20)..(20): C-terminal amidation
FQSKNNVFVSGYFDRLRAKL

SEQ ID NO: 19 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFERLRAKL

SEQ ID NO: 20 - protein, 20 aa, Artificial Sequence
  Synthetic peptide
  MOD_RES (1)..(1): N-terminal acetylation
  MOD_RES (20)..(20): C-terminal amidation
FQSKDNVFVFGYFERLRAKL

SEQ ID NO: 21 - protein, 20 aa, Artificial Sequence
  Synthetic peptide
  MOD_RES (1)..(1): N-terminal acetylation
  MOD_RES (20)..(20): C-terminal amidation
FQSKKNVFVEGYFERLRAKL

SEQ ID NO: 22 - protein, 20 aa, Artificial Sequence
  Synthetic peptide
  MOD_RES (1)..(1): N-terminal acetylation
  MOD_RES (20)..(20): C-terminal amidation
FQSKKNVFVTGYFERLRAKL

SEQ ID NO: 23 - protein, 20 aa, Artificial Sequence
  Synthetic peptide
  MOD_RES (1)..(1): N-terminal acetylation
  MOD_RES (20)..(20): C-terminal amidation
FQSKKNVFVHGYFERLRAKL

SEQ ID NO: 24 - protein, 20 aa, Artificial Sequence
  Synthetic peptide
  MOD_RES (1)..(1): N-terminal acetylation
  MOD_RES (20)..(20): C-terminal amidation
FQSKKNVFVMGYFERLRAKL

SEQ ID NO: 25 - protein, 20 aa, Artificial Sequence
  Synthetic peptide
  MOD_RES (1)..(1): N-terminal acetylation
  MOD_RES (20)..(20): C-terminal amidation
FQSKKNVFVNGYFERLRAKL

SEQ ID NO: 26 - protein, 20 aa, Artificial Sequence
  Synthetic peptide
  MOD_RES (1)..(1): N-terminal acetylation
  MOD_RES (20)..(20): C-terminal amidation
FQSKGNVFVTGYFERLRAKL

SEQ ID NO: 27 - protein, 20 aa, Artificial Sequence
  Synthetic peptide
  MOD_RES (1)..(1): N-terminal acetylation
  MOD_RES (20)..(20): C-terminal amidation
FQSKGNVFVNGYFERLRAKL

SEQ ID NO: 28 - protein, 20 aa, Artificial Sequence
  Synthetic peptide
  MOD_RES (1)..(1): N-terminal acetylation
  MOD_RES (20)..(20): C-terminal amidation
FQSKGNVFVHGYFERLRAKL

SEQ ID NO: 29 - protein, 20 aa, Artificial Sequence
  Synthetic peptide
  MOD_RES (1)..(1): N-terminal acetylation
  MOD_RES (20)..(20): C-terminal amidation
FQSKGNVFVKGYFERLRAKL

SEQ ID NO: 30 - protein, 20 aa, Artificial Sequence
  Synthetic peptide
  MOD_RES (1)..(1): N-terminal acetylation
  MOD_RES (20)..(20): C-terminal amidation
FQSKGNVFVEGYFERLRAKL

SEQ ID NO: 31 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFDRLRAKL

SEQ ID NO: 32 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKL

SEQ ID NO: 33 - protein, 20 aa, Artificial Sequence
  Synthetic peptide
  MOD_RES (1)..(1): N-terminal acetylation
  MOD_RES (20)..(20): C-terminal amidation
FQSKDNVFVTGYFERLRAKL

SEQ ID NO: 34 - protein, 20 aa, Artificial Sequence
  Synthetic peptide
  MOD_RES (1)..(1): N-terminal acetylation
  MOD_RES (20)..(20): C-terminal amidation
FQSKDNVFVNGYFERLRAKL

SEQ ID NO: 35 - protein, 20 aa, Artificial Sequence
  Synthetic peptide
  MOD_RES (1)..(1): N-terminal acetylation
  MOD_RES (20)..(20): C-terminal amidation
FQSKDNVFVHGYFERLRAKL

SEQ ID NO: 36 - protein, 20 aa, Artificial Sequence
  Synthetic peptide
  MOD_RES (1)..(1): N-terminal acetylation
  MOD_RES (20)..(20): C-terminal amidation
FQSKDNVFVKGYFERLRAKL

SEQ ID NO: 37 - protein, 20 aa, Artificial Sequence
  Synthetic peptide
  MOD_RES (1)..(1): N-terminal acetylation
  MOD_RES (20)..(20): C-terminal amidation
FQSKDNVFVEGYFERLRAKL

SEQ ID NO: 38 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLRAKL

SEQ ID NO: 39 - protein, 20 aa, Artificial Sequence
  Synthetic peptide
  MOD_RES (1)..(1): N-terminal acetylation
  MOD_RES (20)..(20): C-terminal amidation
FQSKNNVFVTGYFERLRAKL

SEQ ID NO: 40 - protein, 20 aa, Artificial Sequence
  Synthetic peptide
  MOD_RES (1)..(1): N-terminal acetylation
  MOD_RES (20)..(20): C-terminal amidation
FQSKNNVFVNGYFERLRAKL

SEQ ID NO: 41 - protein, 20 aa, Artificial Sequence
  Synthetic peptide
  MOD_RES (1)..(1): N-terminal acetylation
  MOD_RES (20)..(20): C-terminal amidation
FQSKNNVFVHGYFERLRAKL

SEQ ID NO: 42 - protein, 20 aa, Artificial Sequence
  Synthetic peptide
  MOD_RES (1)..(1): N-terminal acetylation
  MOD_RES (20)..(20): C-terminal amidation
FQSKNNVFVKGYFERLRAKL

SEQ ID NO: 43 - protein, 20 aa, Artificial Sequence
  Synthetic peptide
  MOD_RES (1)..(1): N-terminal acetylation
  MOD_RES (20)..(20): C-terminal amidation
FQSKNNVFVEGYFERLRAKL

SEQ ID NO: 44 - protein, 20 aa, Artificial Sequence
  Synthetic peptide
  MOD_RES (1)..(1): N-terminal acetylation
  MOD_RES (20)..(20): C-terminal amidation
FQSKQNVFVTGYFERLRAKL

SEQ ID NO: 45 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLRAKL

SEQ ID NO: 46 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVFGYFERLRAKL

SEQ ID NO: 47 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVDGYFARLRAKL

SEQ ID NO: 48 - protein, 20 aa, Artificial Sequence
  Synthetic peptide
  MOD_RES (1)..(1): N-terminal acetylation
  MOD_RES (20)..(20): C-terminal amidation
FQSKGNVHVKGYFERLRAKL

SEQ ID NO: 49 - protein, 20 aa, Artificial Sequence
  Synthetic peptide
  MOD_RES (1)..(1): N-terminal acetylation
  MOD_RES (20)..(20): C-terminal amidation
FQSKGNVHVDGYFERLRAKL

SEQ ID NO: 50 - protein, 20 aa, Artificial Sequence
  Synthetic peptide
  MOD_RES (1)..(1): N-terminal acetylation
  MOD_RES (20)..(20): C-terminal amidation
FQSPGNVHVKGYFERLRAKL

SEQ ID NO: 51 - protein, 20 aa, Artificial Sequence
  Synthetic peptide
  MOD_RES (1)..(1): N-terminal acetylation
  MOD_RES (20)..(20): C-terminal amidation
FQSPGNVHVDGYFERLRAKL

SEQ ID NO: 52 - protein, 20 aa, Artificial Sequence
  Synthetic peptide
  MOD_RES (1)..(1): N-terminal acetylation
  MOD_RES (20)..(20): C-terminal amidation
FQSKGNIFVFGYFERLRAKL

SEQ ID NO: 53 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVFGYFERLRAKL

SEQ ID NO: 54 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVTGYFARLRAKL

SEQ ID NO: 55 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVDGYFARLRAKL

SEQ ID NO: 56 - protein, 20 aa, Artificial Sequence
  Synthetic peptide
  MOD_RES (1)..(1): N-terminal acetylation
  MOD_RES (17)..(17): Xaa is (S)-Diaminopropionic acid
  MOD_RES (20)..(20): C-terminal amidation
FQSKGNVFVDGYFERLXAKL

SEQ ID NO: 57 - protein, 20 aa, Artificial Sequence
  Synthetic peptide
  MOD_RES (1)..(1): N-terminal acetylation
  MOD_RES (1)..(1): (S)-Ornithine
  misc_feature (17)..(17): Xaa can be any naturally occurring amino acid
  MOD_RES (20)..(20): C-terminal amidation
FQSKGNVFVDGYFERLXAKL

SEQ ID NO: 58 - protein, 20 aa, Artificial Sequence
  Synthetic peptide
  MOD_RES (1)..(1): N-terminal acetylation
  MOD_RES (17)..(17): Xaa is (S)-2-Amino-pentanoic acid
  MOD_RES (20)..(20): C-terminal amidation
FQSKGNVFVDGYFERLXAKL

SEQ ID NO: 59 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVAGYFERLRAKL

SEQ ID NO: 60 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVDGYFARLRAKL

SEQ ID NO: 61 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVDGYFERLRAKL

SEQ ID NO: 62 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVTGYFARLRAKL

SEQ ID NO: 63 - protein, 20 aa, Artificial Sequence
  Synthetic peptide
  MOD_RES (1)..(1): N-terminal acetylation
  MOD_RES (17)..(17): (S)-Homo-Citrulline
  MOD_RES (20)..(20): C-terminal amidation
FQSKGNVFVDGYFERLXAKL

SEQ ID NO: 64 - protein, 20 aa, Artificial Sequence
  Synthetic peptide
  MOD_RES (1)..(1): N-terminal acetylation
  MOD_RES (17)..(17): (S)-Homo-Arg
  MOD_RES (20)..(20): C-terminal amidation
FQSKGNVFVDGYFERLRAKL

SEQ ID NO: 65 - protein, 20 aa, Artificial Sequence
  Synthetic peptide
  MOD_RES (1)..(1): N-terminal acetylation
  MOD_RES (17)..(17): (S)-2-Pyridyl-Ala
  MOD_RES (20)..(20): C-terminal amidation
FQSKGNVFVDGYFERLAAKL

SEQ ID NO: 66 - protein, 20 aa, Artificial Sequence
  Synthetic peptide
  MOD_RES (1)..(1): N-terminal acetylation
  MOD_RES (17)..(17): Xaa is 2-Amino-isobutryic acid
  MOD_RES (20)..(20): C-terminal amidation
FQSKGNVFVDGYFERLXAKL

SEQ ID NO: 67 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVTGYFARLRAKL

SEQ ID NO: 68 - protein, 20 aa, Artificial Sequence
  Synthetic peptide
  MOD_RES (1)..(1): N-terminal acetylation
  MOD_RES (17)..(17): (S)-N(omega)-nitro-Arg
  MOD_RES (20)..(20): C-terminal amidation
FQSKGNVFVDGYFERLRAKL

SEQ ID NO: 69 - protein, 20 aa, Artificial Sequence
  Synthetic peptide
  MOD_RES (1)..(1): N-terminal acetylation
  MOD_RES (20)..(20): C-terminal amidation
FQSKGNVFVTGYFDRLRAKL

SEQ ID NO: 70 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVFGYFARLRAKL

SEQ ID NO: 71 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is (S)-Norleucine
  MOD_RES (20)..(20): C-terminal amidation
FQSKGNVFVDGYFERLXAKL

SEQ ID NO: 72 - protein, 20 aa, Artificial Sequence
  Synthetic peptide
  MOD_RES (1)..(1): N-terminal acetylation
  MOD_RES (20)..(20): C-terminal amidation
FQSKGAVFVDGYFERLRAKL

SEQ ID NO: 73 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFARLRAKL

SEQ ID NO: 74 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVAGYFARLRAKL

SEQ ID NO: 75 - protein, 20 aa, Artificial Sequence
  Synthetic peptide
  MOD_RES (1)..(1): N-terminal acetylation
  MOD_RES (20)..(20): C-terminal amidation
FQSEGNVFVDGYFERLRAKL

SEQ ID NO: 76 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLHAKL

SEQ ID NO: 77 - protein, 20 aa, Artificial Sequence
  Synthetic peptide
  MOD_RES (1)..(1): N-terminal acetylation
  MOD_RES (20)..(20): C-terminal amidation
FQSIGNVFVDGYFERLRAKL

SEQ ID NO: 78 - protein, 20 aa, Artificial Sequence
  Synthetic peptide
  MOD_RES (1)..(1): N-terminal acetylation
  MOD_RES (20)..(20): C-terminal amidation
FQSKGNIFVDGYFERLRAKL

SEQ ID NO: 79 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVTGYFERLRAKL

SEQ ID NO: 80 - protein, 20 aa, Artificial Sequence
  Synthetic peptide
  MOD_RES (1)..(1): N-terminal acetylation
  MOD_RES (20)..(20): C-terminal amidation
FQSKGKVFVDGYFERLRAKL

SEQ ID NO: 81 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLKAKL

SEQ ID NO: 82 - protein, 20 aa, Artificial Sequence
  Synthetic peptide
  MOD_RES (1)..(1): N-terminal acetylation
  MOD_RES (17)..(17): (S)-2-Propargylglycine
  MOD_RES (20)..(20): C-terminal amidation
FQSKGNVFVDGYFERLGAKL

SEQ ID NO: 83 - protein, 20 aa, Artificial Sequence
  Synthetic peptide
  MOD_RES (1)..(1): N-terminal acetylation
  MOD_RES (20)..(20): C-terminal amidation
FQSLGNVFVDGYFERLRAKL

SEQ ID NO: 84 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFLRLRAKL

SEQ ID NO: 85 - protein, 20 aa, Artificial Sequence
  Synthetic peptide
  MOD_RES (1)..(1): N-terminal acetylation
  MOD_RES (17)..(17): Xaa is (S)-2,4-Diaminobutyric acid
  MOD_RES (20)..(20): C-terminal amidation
FQSKGNVFVDGYFERLXAKL

SEQ ID NO: 86 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLLAKL

SEQ ID NO: 87 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRLKL

SEQ ID NO: 88 - protein, 20 aa, Artificial Sequence
  Synthetic peptide
  MOD_RES (1)..(1): N-terminal acetylation
  MOD_RES (20)..(20): C-terminal amidation
MQSKGNVFVDGYFERLRAKL

SEQ ID NO: 89 - protein, 20 aa, Artificial Sequence
  Synthetic peptide
  MOD_RES (1)..(1): N-terminal acetylation
  MOD_RES (20)..(20): C-terminal amidation
FQMKGNVFVDGYFERLRAKL

SEQ ID NO: 90 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFMRLRAKL

SEQ ID NO: 91 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRMKL

SEQ ID NO: 92 - protein, 20 aa, Artificial Sequence
  Synthetic peptide
  MOD_RES (1)..(1): N-terminal acetylation
  MOD_RES (17)..(17): (S)-Cyclohexylalanine
  MOD_RES (20)..(20): C-terminal amidation
FQSKGNVFVDGYFERLAAKL

SEQ ID NO: 93 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFNRLRAKL

SEQ ID NO: 94 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRNKL

SEQ ID NO: 95 - protein, 20 aa, Artificial Sequence
  Synthetic peptide
  MOD_RES (1)..(1): N-terminal acetylation
  MOD_RES (20)..(20): C-terminal amidation
FQSPGNVFVDGYFERLRAKL

SEQ ID NO: 96 - protein, 20 aa, Artificial Sequence
  Synthetic peptide
  MOD_RES (1)..(1): N-terminal acetylation
  MOD_RES (17)..(17): (S)-2-Amino-5-methyl-hexanoic acid
  MOD_RES (20)..(20): C-terminal amidation
FQSKGNVFVDGYFERLXAKL

SEQ ID NO: 97 - protein, 20 aa, Artificial Sequence
  Synthetic peptide
  MOD_RES (1)..(1): N-terminal acetylation
  MOD_RES (20)..(20): C-terminal amidation
FQQKGNVFVDGYFERLRAKL

SEQ ID NO: 98 - protein, 20 aa, Artificial Sequence
  Synthetic peptide
  MOD_RES (1)..(1): N-terminal acetylation
  MOD_RES (20)..(20): C-terminal amidation
FQSKGQVFVDGYFERLRAKL

SEQ ID NO: 99 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFQRLRAKL

SEQ ID NO: 100 - protein, 20 aa, Artificial Sequence
  Synthetic peptide
  MOD_RES (1)..(1): N-terminal acetylation
  MOD_RES (20)..(20): C-terminal amidation
FQRKGNVFVDGYFERLRAKL

SEQ ID NO: 101 - protein, 20 aa, Artificial Sequence
  Synthetic peptide
  MOD_RES (1)..(1): N-terminal acetylation
  MOD_RES (20)..(20): C-terminal amidation
FQSRGNVFVDGYFERLRAKL

SEQ ID NO: 102 - protein, 20 aa, Artificial Sequence
  Synthetic peptide
  MOD_RES (1)..(1): N-terminal acetylation
  MOD_RES (20)..(20): C-terminal amidation
FQSKGRVFVDGYFERLRAKL

SEQ ID NO: 103 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFRRLRAKL

SEQ ID NO: 104 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKGNVFVDGYFERLXAKL

SEQ ID NO: 105 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRRKL

SEQ ID NO: 106 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is Norleucine
  MOD_RES (20)..(20): C-terminal amidation
FQSKANVFVDGYFERLXAKL

SEQ ID NO: 107 - protein, 20 aa, Artificial Sequence
  Synthetic peptide
  MOD_RES (1)..(1): N-terminal acetylation
  MOD_RES (20)..(20): C-terminal amidation
FQSKGSVFVDGYFERLRAKL

SEQ ID NO: 108 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFTRLRAKL

SEQ ID NO: 109 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVAGYFARLRAKL

SEQ ID NO: 110 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFVRLRAKL

SEQ ID NO: 111 - protein, 20 aa, Artificial Sequence
  Synthetic peptide
  MOD_RES (1)..(1): N-terminal acetylation
  MOD_RES (20)..(20): C-terminal amidation
YQSKGNVFVDGYFERLRAKL

SEQ ID NO: 112 - protein, 20 aa, Artificial Sequence
  Synthetic peptide
  MOD_RES (1)..(1): N-terminal acetylation
  MOD_RES (20)..(20): C-terminal amidation
FQSKGNVYVDGYFERLRAKL

SEQ ID NO: 113 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKGNVFVDGYFARLXAKL

SEQ ID NO: 114 - protein, 20 aa, Artificial Sequence
  Synthetic peptide
  MOD_RES (1)..(1): N-terminal Carboxyfluorescein
  MOD_RES (20)..(20): C-terminal amidation
FQSKGNVFVDGYFERLRAKL

SEQ ID NO: 115 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVDGYFARLRAKL

SEQ ID NO: 116 - protein, 20 aa, Artificial Sequence
  Synthetic peptide
  MOD_RES (1)..(1): N-terminal acetylation
  MOD_RES (20)..(20): C-terminal amidation
FQSKGAVFVDGYFARLRAKL

SEQ ID NO: 117 - protein, 20 aa, Artificial Sequence
  Synthetic peptide
  MOD_RES (1)..(1): N-terminal acetylation
  MOD_RES (5)..(5): D-Asp
  MOD_RES (20)..(20): C-terminal amidation
FQSKDAVFVDGYFARLRAKL

SEQ ID NO: 118 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVAGYFARLRAKL

SEQ ID NO: 119 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKDAVFVAGYFARLRAKL

SEQ ID NO: 120 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVKGYFARLRAKL

SEQ ID NO: 121 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKDAVFVKGYFARLRAKL

SEQ ID NO: 122 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKAVFVTGYFARLRAKL

SEQ ID NO: 123 - protein, 20 aa, Artificial Sequence
  Synthetic peptide
  MOD_RES (1)..(1): N-terminal acetylation
  MOD_RES (5)..(5): D-Asp
  MOD_RES (20)..(20): C-terminal amidation
FQSKDAVFVTGYFARLRAKL

SEQ ID NO: 124 - protein, 21 aa, Artificial Sequence
  Synthetic peptide
  MOD_RES (1)..(1): N-terminal Carboxyfluorescein
  MOD_RES (1)..(1): Xaa is (13-Amino-4,7,10-trioxa-tridecayl)-succinamic acid
  MOD_RES (21)..(21): C-terminal amidation
XFQSKGNVFVDGYFERLRAKL

SEQ ID NO: 125 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVTGYFERLRAKL

SEQ ID NO: 126 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is Norleucine
  MOD_RES (20)..(20): C-terminal amidation
FQSKANVFVDGYFARLXAKL

SEQ ID NO: 127 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVAGYFARLRAKL

SEQ ID NO: 128 - protein, 20 aa, Artificial Sequence
  Synthetic peptide
  MOD_RES (1)..(1): N-terminal acetylation
  MOD_RES (5)..(5): D-Pro
  MOD_RES (20)..(20): C-terminal N-ethyl
FQSKGNVFVFGYFERLRAKL

SEQ ID NO: 129 - protein, 20 aa, Artificial Sequence
  Synthetic peptide
  MOD_RES (1)..(1): N-terminal acetylation
  MOD_RES (20)..(20): C-terminal amidation
FQSKPNVFVFGYFERLRAKL

SEQ ID NO: 130 - protein, 21 aa, Artificial Sequence
  Synthetic peptide
  MOD_RES (1)..(1): N-terminal acetylation
  MOD_RES (21)..(21): C-terminal amidation
FQSKGNVFVDGYFERLRAKLC

SEQ ID NO: 131 - protein, 20 aa, Artificial Sequence
  Synthetic peptide
  MOD_RES (1)..(1): N-terminal acetylation
  MOD_RES (20)..(20): C-terminal amidation
FQSKGNVFVSGYFERLRAKL

SEQ ID NO: 132 - protein, 20 aa, Artificial Sequence
  Synthetic peptide
  MOD_RES (1)..(1): N-terminal acetylation
  MOD_RES (20)..(20): C-terminal amidation
FQSKGNVFVVGYFERLRAKL

SEQ ID NO: 133 - protein, 20 aa, Artificial Sequence
  Synthetic peptide
  MOD_RES (1)..(1): N-terminal acetylation
  MOD_RES (20)..(20): C-terminal amidation
FQSKHHVFVDGYFERLAAKL

SEQ ID NO: 134 - protein, 20 aa, Artificial Sequence
  Synthetic peptide
  MOD_RES (1)..(1): N-terminal acetylation
  MOD_RES (20)..(20): C-terminal amidation
FQSRRGVFVDGYFERLAAKL

SEQ ID NO: 135 - protein, 20 aa, Artificial Sequence
  Synthetic peptide
  MOD_RES (1)..(1): N-terminal acetylation
  MOD_RES (20)..(20): C-terminal amidation
FQCKGNVFVDGYFERLRAKL

SEQ ID NO: 136 - protein, 20 aa, Artificial Sequence
  Synthetic peptide
  MOD_RES (1)..(1): N-terminal acetylation
  MOD_RES (20)..(20): C-terminal amidation
FQSKGCVFVDGYFERLRAKL

SEQ ID NO: 137 - protein, 20 aa, Artificial Sequence
  Synthetic peptide
  MOD_RES (1)..(1): N-terminal acetylation
  MOD_RES (20)..(20): C-terminal amidation
FQSKGNVFVDGYCERLRAKL

SEQ ID NO: 138 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFCRLRAKL

SEQ ID NO: 139 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLCAKL

SEQ ID NO: 140 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLCAKL

SEQ ID NO: 141 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFMRLCAKL

SEQ ID NO: 142 - protein, 20 aa, Artificial Sequence
  Synthetic peptide
  MOD_RES (1)..(1): N-terminal acetylation
  MOD_RES (20)..(20): C-terminal amidation
FQSKDNVFVHGYFERLCAKL

SEQ ID NO: 143 - protein, 20 aa, Artificial Sequence
  Synthetic peptide
  MOD_RES (1)..(1): N-terminal acetylation
  MOD_RES (20)..(20): C-terminal amidation
YQSKNNVFVDGYFERLCAKL

SEQ ID NO: 144 - protein, 20 aa, Artificial Sequence
  Synthetic peptide
  MOD_RES (1)..(1): N-terminal acetylation
  MOD_RES (20)..(20): C-terminal amidation
FQSKGHVFVDGYFERLCAKL

SEQ ID NO: 145 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLCAKL

SEQ ID NO: 146 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLCAKL

SEQ ID NO: 147 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLCAKL

SEQ ID NO: 148 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLCAKL

SEQ ID NO: 149 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFERLCAKL

SEQ ID NO: 150 - protein, 20 aa, Artificial Sequence
  Synthetic peptide
  MOD_RES (1)..(1): N-terminal acetylation
  MOD_RES (20)..(20): C-terminal amidation
FQSKDHVFVDGYFERLCAKL

SEQ ID NO: 151 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLCAKL

SEQ ID NO: 152 - protein, 20 aa, Artificial Sequence
  Synthetic peptide
  MOD_RES (1)..(1): N-terminal acetylation
  MOD_RES (20)..(20): C-terminal amidation
FQSKHHVFVDGYFERLCAKL

SEQ ID NO: 153 - protein, 20 aa, Artificial Sequence
  Synthetic peptide
  MOD_RES (1)..(1): N-terminal acetylation
  MOD_RES (20)..(20): C-terminal amidation
FQSKHNVYVDGYFERLCAKL

SEQ ID NO: 154 - protein, 20 aa, Artificial Sequence
  Synthetic peptide
  MOD_RES (1)..(1): N-terminal acetylation
  MOD_RES (20)..(20): C-terminal amidation
FQSRRGVFVDGYFERLCAKL

SEQ ID NO: 155 - protein, 20 aa, Artificial Sequence
  Synthetic peptide
  MOD_RES (1)..(1): N-terminal acetylation
  MOD_RES (20)..(20): C-terminal amidation
YQSKQNVFVDGYFERLCAKL

SEQ ID NO: 156 - protein, 20 aa, Artificial Sequence
  Synthetic peptide
  MOD_RES (1)..(1): N-terminal acetylation
  MOD_RES (20)..(20): C-terminal amidation
FQSEHNVFVDGYFERLCAKL

SEQ ID NO: 157 - protein, 20 aa, Artificial Sequence
  Synthetic peptide
  MOD_RES (1)..(1): N-terminal acetylation
  MOD_RES (20)..(20): C-terminal amidation
FQSKNDVFVDGYFERLCAKL

SEQ ID NO: 158 - protein, 20 aa, Artificial Sequence
  Synthetic peptide
  MOD_RES (1)..(1): N-terminal acetylation
  MOD_RES (20)..(20): C-terminal amidation
FQSKRNVFVDGYFERLCAKL

SEQ ID NO: 159 - protein, 20 aa, Artificial Sequence
  Synthetic peptide
  MOD_RES (1)..(1): N-terminal acetylation
  MOD_RES (20)..(20): C-terminal amidation
FQSPKNVFVDGYFERLCAKL

SEQ ID NO: 160 - protein, 20 aa, Artificial Sequence
  Synthetic peptide
  MOD_RES (1)..(1): N-terminal acetylation
  MOD_RES (20)..(20): C-terminal amidation
FQSGKNVFVDGYFERLCAKL

SEQ ID NO: 161 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGNVFVAGYFERLRAKL

SEQ ID NO: 162 - protein, 20 aa, Artificial Sequence
  Synthetic peptide
  MOD_RES (1)..(1): N-terminal acetylation
  MOD_RES (4)..(4): Xaa is 2-Amino-isobutyric acid
  MOD_RES (17)..(17): Xaa is 2-Amino-isobutyric acid
  MOD_RES (20)..(20): C-terminal amidation
FQSXGNVFVDGYFERLXAKL

SEQ ID NO: 163 - protein, 20 aa, Artificial Sequence
  Synthetic peptide
  MOD_RES (1)..(1): N-terminal acetylation
  MOD_RES (5)..(5): Xaa is 2-Amino-isobutyric acid
  MOD_RES (17)..(17): Xaa is 2-Amino-isobutyric acid
  MOD_RES (20)..(20): C-terminal amidation
FQSKXNVFVDGYFERLXAKL

SEQ ID NO: 164 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-Amino-isobutyric acid
  MOD_RES (20)..(20): C-terminal amidation
FQSKGNVFVDGYFERLXAKL

SEQ ID NO: 165 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-Amino-isobutyric acid
  MOD_RES (20)..(20): C-terminal amidation
FQSKGNVFVTGYFERLXAKL

SEQ ID NO: 166 - protein, 20 aa, Artificial Sequence
  Synthetic peptide
  MOD_RES (1)..(1): N-terminal Aminooxy acetate
  MOD_RES (17)..(17): Xaa is 2-Amino-isobutyric acid
  MOD_RES (20)..(20): C-terminal amidation
FQSKGNVFVDGYFERLXAKL

SEQ ID NO: 167 - protein, 21 aa, Artificial Sequence
  Synthetic peptide
  MOD_RES (1)..(1): N-terminal acetylation
  DISULFID (14)..(21): Cys residues linked via disulfide bond
  MOD_RES (17)..(17): Xaa is 2-Amino-isobutyric acid
  MOD_RES (21)..(21): C-terminal amidation
FQSKGNVFVDGYFERLXAKLC

SEQ ID NO: 168 - protein, 21 aa, Artificial Sequence
  Synthetic peptide
  MOD_RES (1)..(1): N-terminal acetylation
  DISULFID (14)..(21): Cys residues linked via disulfide bond
  MOD_RES (17)..(17): Xaa is 2-Amino-isobutryic acid
  MOD_RES (20)..(20): C-terminal amidation
FQSKGNVFVDGYFCRLXAKLC

SEQ ID NO: 169 - protein, 20 aa, Artificial Sequence
  Synthetic peptide
  MOD_RES (1)..(1): N-terminal acetylation
  MOD_RES (20)..(20): C-terminal amidation
FQSKGNIFVDGYFERLHAKL

SEQ ID NO: 170 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFKRLRAKL

SEQ ID NO: 171 - protein, 20 aa, Artificial Sequence
  Synthetic peptide
  MOD_RES (1)..(1): N-terminal acetylation
  MOD_RES (20)..(20): C-terminal amidation
YQTKGNVFVDGYFERLRAKL

SEQ ID NO: 172 - protein, 20 aa, Artificial Sequence
  Synthetic peptide
  MOD_RES (1)..(1): N-terminal acetylation
  MOD_RES (20)..(20): C-terminal amidation
FQTKDNVHVDGYFERLRAKL

SEQ ID NO: 173 - protein, 20 aa, Artificial Sequence
  Synthetic peptide
  MOD_RES (1)..(1): N-terminal acetylation
  MOD_RES (20)..(20): C-terminal amidation
LQQKGNVFVDGYFERLRAKL

SEQ ID NO: 174 - protein, 20 aa, Artificial Sequence
  Synthetic peptide
  MOD_RES (1)..(1): N-terminal pegylation
  MOD_RES (17)..(17): Xaa is 2-Amino-isobutyric acid
  MOD_RES (20)..(20): C-terminal amidation
FQSKGNVFVDGYFERLXAKL

SEQ ID NO: 175 - protein, 20 aa, Artificial Sequence
  Synthetic peptide
  MOD_RES (1)..(1): N-terminal pegylation
  MOD_RES (17)..(17): Xaa is 2-Amino-isobutyric acid
  MOD_RES (20)..(20): C-terminal amidation
FQSKGNVFVDGYFERLXAKL

SEQ ID NO: 176 - protein, 21 aa, Artificial Sequence
  Synthetic peptide
  MOD_RES (1)..(1): N-terminal acetylation
  MOD_RES (17)..(17): Xaa is 2-Amino-isobutyric acid
  MOD_RES (21)..(21): PEGYLATION
  MOD_RES (21)..(21): C-terminal amidation
FQSKGNVFVDGYFERLXAKLC

SEQ ID NO: 177 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-Amino-isobutyric acid
  MOD_RES (20)..(20): C-terminal amidation
FQSKPNVFVDGYFERLXAKL

SEQ ID NO: 178 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-Amino-isobutyric acid
  MOD_RES (20)..(20): C-terminal amidation
FQSKPNVHVDGYFERLXAKL

SEQ ID NO: 179 - protein, 21 aa, Artificial Sequence
  Synthetic peptide
  MOD_RES (1)..(1): N-terminal acetylation
  MOD_RES (21)..(21): C-terminal amidation
PFQSKGNVFVDGYFERLRAKL

SEQ ID NO: 180 - protein, 22 aa, Artificial Sequence
  Synthetic peptide
  MOD_RES (1)..(1): N-terminal acetylation
  MOD_RES (20)..(20): C-terminal amidation
PEFQSKGNVFVDGYFERLRAKL

SEQ ID NO: 181 - protein, 21 aa, Artificial Sequence
  Synthetic peptide
  MOD_RES (1)..(1): N-terminal acetylation
  MOD_RES (6)..(6): (S)-N-methyl-Glu
  MOD_RES (18)..(18): Xaa is 2-Amino-isobutyric acid
  MOD_RES (21)..(21): C-terminal amidation
PFQSKENVFVDGYFERLXAKL

SEQ ID NO: 182 - protein, 26 aa, Artificial Sequence
  Synthetic peptide
  MOD_RES (1)..(1): N-terminal acetylation
  MOD_RES (26)..(26): C-terminal amidation
KKAFQSKKNVFVFGYFERLRAKLTKK

SEQ ID NO: 183 - protein, 20 aa, Artificial Sequence
  Synthetic peptide
  MOD_RES (1)..(1): N-terminal acetylation
  MOD_RES (20)..(20): C-terminal amidation
FQSKNNVFVFGYFERLRAKL

SEQ ID NO: 184 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLRAKL

SEQ ID NO: 185 - protein, 20 aa, Artificial Sequence
  Synthetic peptide
  MOD_RES (1)..(1): N-terminal acetylation
  MOD_RES (20)..(20): C-terminal amidation
FQSKKNVFVSGYFERLRAKL

SEQ ID NO: 186 - protein, 20 aa, Artificial Sequence
  Synthetic peptide
  MOD_RES (1)..(1): N-terminal acetylation
  MOD_RES (20)..(20): C-terminal amidation
FQSKNNVFVYGYFDRLRAKL

SEQ ID NO: 187 - protein, 20 aa, Artificial Sequence
  Synthetic peptide
  MOD_RES (1)..(1): N-terminal acetylation
  MOD_RES (20)..(20): C-terminal amidation
FQSKNNVFVFGYFDRLRAKL

SEQ ID NO: 188 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFDRLRAKL

SEQ ID NO: 189 - protein, 20 aa, Artificial Sequence
  Synthetic peptide
  MOD_RES (1)..(1): N-terminal Carboxyfluorescein
  MOD_RES (20)..(20): C-terminal amidation
AFQSKKNVFVFGYFERLRAK

SEQ ID NO: 190 - protein, 20 aa, Artificial Sequence
  Synthetic peptide
  MOD_RES (1)..(1): N-terminal acetylation
  MOD_RES (20)..(20): C-terminal amidation
FQSKGNVFVFGYFERLRAKL

SEQ ID NO: 191 - protein, 20 aa, Artificial Sequence
  Synthetic peptide
  MOD_RES (1)..(1): N-terminal acetylation
  MOD_RES (20)..(20): C-terminal amidation
FQSKKNVFVVGYFERLRAKL

SEQ ID NO: 192 - protein, 20 aa, Artificial Sequence
  Synthetic peptide
  MOD_RES (1)..(1): N-terminal acetylation
  MOD_RES (20)..(20): C-terminal amidation
FQSKKNVHVFGYFERLRAKL

SEQ ID NO: 193 - protein, 20 aa, Artificial Sequence
  Synthetic peptide
  MOD_RES (1)..(1): N-terminal acetylation
  MOD_RES (20)..(20): C-terminal amidation
FQSKKNVFVKGYFERLRAKL

SEQ ID NO: 194 - protein, 20 aa, Artificial Sequence
  Synthetic peptide
  MOD_RES (1)..(1): N-terminal acetylation
  MOD_RES (20)..(20): C-terminal amidation
FQSKKNVFVPGYFERLRAKL

SEQ ID NO: 195 - protein, 20 aa, Artificial Sequence
  Synthetic peptide
  MOD_RES (1)..(1): N-terminal acetylation
  MOD_RES (20)..(20): C-terminal amidation
FQSKKNVFVRGYFERLRAKL

SEQ ID NO: 196 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEELRAKL

SEQ ID NO: 197 - protein, 20 aa, Artificial Sequence
  Synthetic peptide
  MOD_RES (1)..(1): N-terminal acetylation
  MOD_RES (20)..(20): C-terminal amidation
FQSKQNVFVNGYFERLRAKL

SEQ ID NO: 198 - protein, 20 aa, Artificial Sequence
  Synthetic peptide
  MOD_RES (1)..(1): N-terminal acetylation
  MOD_RES (20)..(20): C-terminal amidation
FQSKQNVFVHGYFERLRAKL

SEQ ID NO: 199 - protein, 20 aa, Artificial Sequence
  Synthetic peptide
  MOD_RES (1)..(1): N-terminal acetylation
  MOD_RES (20)..(20): C-terminal amidation
FQSKQNVFVKGYFERLRAKL

SEQ ID NO: 200 - protein, 20 aa, Artificial Sequence
  Synthetic peptide
  MOD_RES (1)..(1): N-terminal acetylation
  MOD_RES (20)..(20): C-terminal amidation
FQSKQNVFVEGYFERLRAKL

SEQ ID NO: 201 - protein, 20 aa, Artificial Sequence
  Synthetic peptide
  MOD_RES (1)..(1): N-terminal acetylation
  MOD_RES (1)..(1): (S)-N-methyl-phenylalanine
  MOD_RES (20)..(20): C-terminal amidation
AQSKGNVFVFGYFERLRAKL

SEQ ID NO: 202 - protein, 20 aa, Artificial Sequence
  Synthetic peptide
  MOD_RES (1)..(1): N-terminal acetylation
  MOD_RES (4)..(4): (S)-N-methyl-lysine
  MOD_RES (20)..(20): C-terminal amidation
FQSKGNVFVFGYFERLRAKL

SEQ ID NO: 203 - protein, 20 aa, Artificial Sequence
  Synthetic peptide
  MOD_RES (1)..(1): N-terminal acetylation
  MOD_RES (17)..(17): beta-Homoarginine
  MOD_RES (20)..(20): C-terminal amidation
FQSKGNVFVFGYFERLRAKL

SEQ ID NO: 204 - protein, 20 aa, Artificial Sequence
  Synthetic peptide
  MOD_RES (1)..(1): N-terminal acetylation
  MOD_RES (20)..(20): beta-Homoleucine
  MOD_RES (20)..(20): C-terminal amidation
FQSKGNVFVFGYFERLRAKL

SEQ ID NO: 205 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFKRLRAKL

SEQ ID NO: 206 - protein, 20 aa, Artificial Sequence
  Synthetic peptide
  MOD_RES (1)..(1): N-terminal acetylation
  MOD_RES (5)..(5): N-methyl-Gly
  MOD_RES (20)..(20): C-terminal amidation
FQSKGAVFVFGYFARLRAKL

SEQ ID NO: 207 - protein, 20 aa, Artificial Sequence
  Synthetic peptide
  MOD_RES (1)..(1): N-terminal acetylation
  MOD_RES (5)..(5): D-Lys
  MOD_RES (20)..(20): C-terminal amidation
FQSKKNVFVFGYFERLRAKL

SEQ ID NO: 208 - protein, 20 aa, Artificial Sequence
  Synthetic peptide
  MOD_RES (1)..(1): N-terminal acetylation
  MOD_RES (20)..(20): C-terminal amidation
FQSKGNVFVNGYFDRLRAKL

SEQ ID NO: 209 - protein, 20 aa, Artificial Sequence
  Synthetic peptide
  MOD_RES (1)..(1): N-terminal acetylation
  MOD_RES (20)..(20): C-terminal amidation
FQSKGNVFVKGYFDRLRAKL

SEQ ID NO: 210 - protein, 20 aa, Artificial Sequence
  Synthetic peptide
  MOD_RES (1)..(1): N-terminal acetylation
  MOD_RES (20)..(20): C-terminal amidation
FQSKGNVFVEGYFDRLRAKL

SEQ ID NO: 211 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFKRLRAKL

SEQ ID NO: 212 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLAAKL

SEQ ID NO: 213 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is Norleucine
  MOD_RES (20)..(20): C-terminal amidation
FQSKGNVFVTGYFERLXAKL

SEQ ID NO: 214 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVTGYFARLRAKL

SEQ ID NO: 215 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVDGYFARLRAKL

SEQ ID NO: 216 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLIAKL

SEQ ID NO: 217 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVFGYFARLRAKL

SEQ ID NO: 218 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is Norleucine
  MOD_RES (20)..(20): C-terminal amidation
FQSKGAVFVAGYFARLXAKL

SEQ ID NO: 219 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLVAKL

SEQ ID NO: 220 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFWRLRAKL

SEQ ID NO: 221 - protein, 20 aa, Artificial Sequence
  Synthetic peptide
  MOD_RES (1)..(1): N-terminal acetylation
  MOD_RES (20)..(20): C-terminal amidation
FQSKDAVFVDGYFARLRAKL

SEQ ID NO: 222 - protein, 20 aa, Artificial Sequence
  Synthetic peptide
  MOD_RES (1)..(1): N-terminal acetylation
  MOD_RES (20)..(20): C-terminal amidation
FQSKGAVFVAGYFARLRAKL

SEQ ID NO: 223 - protein, 20 aa, Artificial Sequence
  Synthetic peptide
  MOD_RES (1)..(1): N-terminal acetylation
  MOD_RES (20)..(20): C-terminal amidation
FQSKDAVFVAGYFARLRAKL

SEQ ID NO: 224 - protein, 20 aa, Artificial Sequence
  Synthetic peptide
  MOD_RES (1)..(1): N-terminal acetylation
  MOD_RES (20)..(20): C-terminal amidation
FQSKGAVFVKGYFARLRAKL

SEQ ID NO: 225 - protein, 20 aa, Artificial Sequence
  Synthetic peptide
  MOD_RES (1)..(1): N-terminal acetylation
  MOD_RES (20)..(20): C-terminal amidation
FQSKDAVFVKGYFARLRAKL

SEQ ID NO: 226 - protein, 20 aa, Artificial Sequence
  Synthetic peptide
  MOD_RES (1)..(1): N-terminal acetylation
  MOD_RES (20)..(20): C-terminal amidation
FQSKGAVFVTGYFARLRAKL

SEQ ID NO: 227 - protein, 20 aa, Artificial Sequence
  Synthetic peptide
  MOD_RES (1)..(1): N-terminal acetylation
  MOD_RES (20)..(20): C-terminal amidation
FQSKDAVFVTGYFARLRAKL

SEQ ID NO: 228 - protein, 20 aa, Artificial Sequence
  Synthetic peptide
  MOD_RES (1)..(1): N-terminal acetylation
  MOD_RES (20)..(20): C-terminal N-methyl
FQSKGNVFVFGYFERLRAKL

SEQ ID NO: 229 - protein, 20 aa, Artificial Sequence
  Synthetic peptide
  MOD_RES (1)..(1): N-terminal acetylation
  MOD_RES (20)..(20): C-terminal amidation
FQSKFNVFVDGYFERLRAKL

SEQ ID NO: 230 - protein, 20 aa, Artificial Sequence
  Synthetic peptide
  MOD_RES (1)..(1): N-terminal acetylation
  MOD_RES (20)..(20): C-terminal amidation
FQSKGNVFVAGYFERLRAKL

SEQ ID NO: 231 - protein, 20 aa, Artificial Sequence
  Synthetic peptide
  MOD_RES (1)..(1): N-terminal acetylation
  MOD_RES (20)..(20): C-terminal amidation
FQSKGNVFVMGYFERLRAKL

SEQ ID NO: 232 - protein, 20 aa, Artificial Sequence
  Synthetic peptide
  MOD_RES (1)..(1): N-terminal acetylation
  MOD_RES (20)..(20): C-terminal amidation
FQSKGNVFVPGYFERLRAKL

SEQ ID NO: 233 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFMRLAAKL

SEQ ID NO: 234 - protein, 20 aa, Artificial Sequence
  Synthetic peptide
  MOD_RES (1)..(1): N-terminal acetylation
  MOD_RES (20)..(20): C-terminal amidation
YQSKNNVFVDGYFERLAAKL

SEQ ID NO: 235 - protein, 20 aa, Artificial Sequence
  Synthetic peptide
  MOD_RES (1)..(1): N-terminal acetylation
  MOD_RES (20)..(20): C-terminal amidation
FQSKGHVFVDGYFERLAAKL

SEQ ID NO: 236 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLAAKL

SEQ ID NO: 237 - protein, 20 aa, Artificial Sequence
  Synthetic peptide
  MOD_RES (1)..(1): N-terminal acetylation
  MOD_RES (20)..(20): C-terminal amidation
FQTKHNVFVDGYFERLAAKL

SEQ ID NO: 238 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLAAKL

SEQ ID NO: 239 - protein, 20 aa, Artificial Sequence
  Synthetic peptide
  MOD_RES (1)..(1): N-terminal acetylation
  MOD_RES (20)..(20): C-terminal amidation
FQSKNNVFVDGYFERLAAKL

SEQ ID NO: 240 - protein, 20 aa, Artificial Sequence
  Synthetic peptide
  MOD_RES (1)..(1): N-terminal acetylation
  MOD_RES (20)..(20): C-terminal amidation
FQSKDHVFVDGYFERLAAKL

SEQ ID NO: 241 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLARKL

SEQ ID NO: 242 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLAAKL

SEQ ID NO: 243 - protein, 20 aa, Artificial Sequence
  Synthetic peptide
  MOD_RES (1)..(1): N-terminal acetylation
  MOD_RES (20)..(20): C-terminal amidation
FQSKLNVFVDGYFERLAAKL

SEQ ID NO: 244 - protein, 20 aa, Artificial Sequence
  Synthetic peptide
  MOD_RES (1)..(1): N-terminal acetylation
  MOD_RES (20)..(20): C-terminal amidation
FQSVGNVFVDGYFERLSAKL

SEQ ID NO: 245 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLRAKL

SEQ ID NO: 246 - protein, 20 aa, Artificial Sequence
  Synthetic peptide
  MOD_RES (1)..(1): N-terminal acetylation
  MOD_RES (20)..(20): C-terminal amidation
FQSGGNVFVDGYFERLCAKL

SEQ ID NO: 247 - protein, 20 aa, Artificial Sequence
  Synthetic peptide
  MOD_RES (1)..(1): N-terminal acetylation
  MOD_RES (13)..(13): Xaa is 2-Amino-isobutyric acid
  MOD_RES (17)..(17): Xaa is 2-Amino-isobutyric acid
  MOD_RES (20)..(20): C-terminal amidation
FQSKGNVFVDGYXERLXAKL

SEQ ID NO: 248 - protein, 20 aa, Artificial Sequence
  Synthetic peptide
  MOD_RES (1)..(1): N-terminal acetylation
  MOD_RES (14)..(14): Xaa is 2-Amino-isobutyric acid
  MOD_RES (17)..(17): Xaa is 2-Amino-isobutyric acid
  MOD_RES (20)..(20): C-terminal amidation
FQSKGNVFVDGYFXRLXAKL

SEQ ID NO: 249 - protein, 20 aa, Artificial Sequence
  Synthetic peptide
  MOD_RES (1)..(1): N-terminal acetylation
  MOD_RES (20)..(20): C-terminal amidation
FQSYKHVFVDGYFERLRAKL

SEQ ID NO: 250 - protein, 20 aa, Artificial Sequence
  Synthetic peptide
  MOD_RES (1)..(1): N-terminal acetylation
  MOD_RES (20)..(20): C-terminal amidation
FQSKGIVFVDGYFKRLRAKL

SEQ ID NO: 251 - protein, 20 aa, Artificial Sequence
  Synthetic peptide
  MOD_RES (1)..(1): N-terminal acetylation
  MOD_RES (20)..(20): C-terminal amidation
FQSYKRVFVDGYFERLRAKL

SEQ ID NO: 252 - protein, 21 aa, Artificial Sequence
  Synthetic peptide
  MOD_RES (1)..(1): N-terminal acetylation
  MOD_RES (17)..(17): Xaa is 2-Amino-isobutyric acid
  MOD_RES (21)..(21): PEGYLATION
  MOD_RES (21)..(21): C-terminal amidation
FQSKGNVFVDGYFERLXAKLC

SEQ ID NO: 253 - protein, 31 aa, Artificial Sequence
  Synthetic peptide
  MOD_RES (1)..(1): N-terminal acetylation
  MOD_RES (31)..(31): C-terminal amidation
SGVGRLQVAFQSKKNVFVFGYFERLRAKLTS

SEQ ID NO: 254 - protein, 24 aa, Artificial Sequence
  Synthetic peptide
  MOD_RES (1)..(1): N-terminal acetylation
  MOD_RES (24)..(24): C-terminal amidation
KKAFQSKKNVFVFGYFERLRAKKK

SEQ ID NO: 255 - protein, 24 aa, Artificial Sequence
  Synthetic peptide
  MOD_RES (1)..(1): N-terminal acetylation
  MOD_RES (24)..(24): C-terminal amidation
KKQSKKNVFVFGYFERLRAKLTKK

SEQ ID NO: 256 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKL

SEQ ID NO: 257 - protein, 20 aa, Artificial Sequence
  Synthetic peptide
  MOD_RES (1)..(1): N-terminal acetylation
  MOD_RES (20)..(20): C-terminal amidation
YQSKKNVFVFGYFERLRAKL

SEQ ID NO: 258 - protein, 20 aa, Artificial Sequence
  Synthetic peptide
  MOD_RES (1)..(1): N-terminal acetylation
  MOD_RES (20)..(20): C-terminal amidation
FQSKKNVFVAGYFERLRAKL

SEQ ID NO: 259 - protein, 20 aa, Artificial Sequence
  Synthetic peptide
  MOD_RES (1)..(1): N-terminal acetylation
  MOD_RES (20)..(20): C-terminal amidation
FQSKKNVFVLGYFERLRAKL

SEQ ID NO: 260 - protein, 20 aa, Artificial Sequence
  Synthetic peptide
  MOD_RES (1)..(1): N-terminal acetylation
  MOD_RES (20)..(20): C-terminal amidation
FQSKKNVFVQGYFERLRAKL

SEQ ID NO: 261 - protein, 20 aa, Artificial Sequence
  Synthetic peptide
  MOD_RES (1)..(1): N-terminal acetylation
  MOD_RES (20)..(20): C-terminal amidation
FQSKKNVFVYGYFERLRAKL

SEQ ID NO: 262 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFDRLRAKL

SEQ ID NO: 263 - protein, 20 aa, Artificial Sequence
  Synthetic peptide
  MOD_RES (1)..(1): N-terminal acetylation
FQSKNNVFVAGYFDRLRAKL

SEQ ID NO: 264 - protein, 20 aa, Artificial Sequence
  Synthetic peptide
  MOD_RES (1)..(1): N-terminal acetylation
  MOD_RES (20)..(20): C-terminal amidation
FQSKKNQFVFGYFERLRAKL

SEQ ID NO: 265 - protein, 20 aa, Artificial Sequence
  Synthetic peptide
  MOD_RES (1)..(1): N-terminal acetylation
  MOD_RES (20)..(20): C-terminal amidation
FQSPKNVFVFGYFERLRAKL

SEQ ID NO: 266 - protein, 20 aa, Artificial Sequence
  Synthetic peptide
  MOD_RES (1)..(1): N-terminal acetylation
  MOD_RES (20)..(20): C-terminal amidation
FQSKKNVFVGGYFERLRAKL

SEQ ID NO: 267 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFLRLRAKL

SEQ ID NO: 268 - protein, 21 aa, Artificial Sequence
  Synthetic peptide
  MOD_RES (1)..(1): N-terminal acetylation
  MOD_RES (1)..(1): Xaa is 13-Amino-4,7,10-trioxa-tridecayl)-succinamic acid
  MOD_RES (20)..(20): C-terminal amidation
XFQSKKNVFVFGYFERLRAKL

SEQ ID NO: 269 - protein, 20 aa, Artificial Sequence
  Synthetic peptide
  MOD_RES (1)..(1): N-terminal acetylation
  MOD_RES (11)..(11): N-methyl-Gly
  MOD_RES (20)..(20): C-terminal amidation
FQSKGNVFVFGYFERLRAKL

SEQ ID NO: 270 - protein, 20 aa, Artificial Sequence
  Synthetic peptide
  MOD_RES (1)..(1): N-terminal acetylation
  MOD_RES (5)..(5): beta-Ala
  MOD_RES (20)..(20): C-terminal amidation
FQSKANVFVFGYFERLRAKL

SEQ ID NO: 271 - protein, 20 aa, Artificial Sequence
  Synthetic peptide
  MOD_RES (1)..(1): N-terminal acetylation
  MOD_RES (6)..(6): beta-Homoasparagin
  MOD_RES (20)..(20): C-terminal amidation
FQSKGDVFVFGYFERLRAKL

SEQ ID NO: 272 - protein, 20 aa, Artificial Sequence
  Synthetic peptide
  MOD_RES (1)..(1): N-terminal acetylation
  MOD_RES (14)..(14): beta-Homoaspartic acid
  MOD_RES (20)..(20): C-terminal amidation
FQSKGNVFVFGYFDRLRAKL

SEQ ID NO: 273 - protein, 20 aa, Artificial Sequence
  Synthetic peptide
  MOD_RES (1)..(1): N-terminal acetylation
  MOD_RES (17)..(17): Xaa is (S)-Citrullin
  MOD_RES (20)..(20): C-terminal amidation
FQSKGNVFVFGYFERLXAKL

SEQ ID NO: 274 - protein, 20 aa, Artificial Sequence
  Synthetic peptide
  MOD_RES (1)..(1): N-terminal acetylation
  MOD_RES (20)..(20): C-terminal amidation
FQSGKNVFVFGYFERLRAKL

SEQ ID NO: 275 - protein, 20 aa, Artificial Sequence
  Synthetic peptide
  MOD_RES (1)..(1): N-terminal acetylation
  MOD_RES (20)..(20): C-terminal amidation
FQSKKGVFVFGYFERLRAKL

SEQ ID NO: 276 - protein, 20 aa, Artificial Sequence
  Synthetic peptide
  MOD_RES (1)..(1): N-terminal acetylation
  MOD_RES (20)..(20): C-terminal amidation
FQKKKNVFVFGYFERLRAKL

SEQ ID NO: 277 - protein, 20 aa, Artificial Sequence
  Synthetic peptide
  MOD_RES (1)..(1): N-terminal acetylation
  MOD_RES (20)..(20): C-terminal amidation
FQSKKKVFVFGYFERLRAKL

SEQ ID NO: 278 - protein, 20 aa, Artificial Sequence
  Synthetic peptide
  MOD_RES (1)..(1): N-terminal acetylation
  MOD_RES (20)..(20): C-terminal amidation
FQSKKNKFVFGYFERLRAKL

SEQ ID NO: 279 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLKAKL

SEQ ID NO: 280 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRKKL

SEQ ID NO: 281 - protein, 20 aa, Artificial Sequence
  Synthetic peptide
  MOD_RES (1)..(1): N-terminal acetylation
  MOD_RES (20)..(20): C-terminal amidation
FQDKKNVFVFGYFERLRAKL

SEQ ID NO: 282 - protein, 20 aa, Artificial Sequence
  Synthetic peptide
  MOD_RES (1)..(1): N-terminal acetylation
  MOD_RES (20)..(20): C-terminal amidation
FQSKKDVFVFGYFERLRAKL

SEQ ID NO: 283 - protein, 20 aa, Artificial Sequence
  Synthetic peptide
  MOD_RES (1)..(1): N-terminal acetylation
FQSKGNVFVFGYFERLRAKL

SEQ ID NO: 284 - protein, 20 aa, Artificial Sequence
  Synthetic peptide
  MOD_RES (20)..(20): C-terminal amidation
FQSKGNVFVFGYFERLRAKL

SEQ ID NO: 285 - protein, 22 aa, Artificial Sequence
  Synthetic peptide
GSFQSKKNVFVDGYFERLRAKL

SEQ ID NO: 286 - protein, 20 aa, Artificial Sequence
  Synthetic peptide
  MOD_RES (1)..(1): N-terminal acetylation
  MOD_RES (20)..(20): C-terminal amidation
FQSKGNLFVFGYFERLRAKL

SEQ ID NO: 287 - protein, 20 aa, Artificial Sequence
  Synthetic peptide
  MOD_RES (1)..(1): N-terminal acetylation
  MOD_RES (20)..(20): C-terminal amidation
FQSKGNVFIFGYFERLRAKL

SEQ ID NO: 288 - protein, 20 aa, Artificial Sequence
  Synthetic peptide
  MOD_RES (1)..(1): N-terminal acetylation
  MOD_RES (20)..(20): C-terminal amidation
FQSKKAVFVFGYFERLRAKL

SEQ ID NO: 289 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFARLRAKL

SEQ ID NO: 290 - protein, 20 aa, Artificial Sequence
  Synthetic peptide
  MOD_RES (1)..(1): N-terminal acetylation
  MOD_RES (4)..(4): D-Lys
  MOD_RES (20)..(20): C-terminal amidation
FQSKKNVFVFGYFERLRAKL

SEQ ID NO: 291 - protein, 20 aa, Artificial Sequence
  Synthetic peptide
  MOD_RES (1)..(1): N-terminal acetylation
  MOD_RES (9)..(9): D-Phe
  MOD_RES (20)..(20): C-terminal amidation
FQSKKNVFFFGYFERLRAKL

SEQ ID NO: 292 - protein, 20 aa, Artificial Sequence
  Synthetic peptide
  MOD_RES (1)..(1): N-terminal acetylation
  MOD_RES (20)..(20): C-terminal amidation
FQSKGNVFVHGYFDRLRAKL

SEQ ID NO: 293 - protein, 20 aa, Artificial Sequence
  Synthetic peptide
  MOD_RES (1)..(1): N-terminal acetylation
  MOD_RES (17)..(17): omega-methyl-Arg
  MOD_RES (20)..(20): C-terminal amidation
FQSKKNVFVFGYFERLRAKL

SEQ ID NO: 294 - protein, 20 aa, Artificial Sequence
  Synthetic peptide
  MOD_RES (1)..(1): N-terminal acetylation
  MOD_RES (20)..(20): C-terminal amidation
FQAKGNVFVDGYFERLRAKL

SEQ ID NO: 295 - protein, 20 aa, Artificial Sequence
  Synthetic peptide
  MOD_RES (1)..(1): N-terminal acetylation
  MOD_RES (20)..(20): C-terminal amidation
FQSAGNVFVDGYFERLRAKL

SEQ ID NO: 296 - protein, 20 aa, Artificial Sequence
  Synthetic peptide
  MOD_RES (1)..(1): N-terminal acetylation
  MOD_RES (20)..(20): C-terminal amidation
FQSDGNVFVDGYFERLRAKL

SEQ ID NO: 297 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRDKL

SEQ ID NO: 298 - protein, 20 aa, Artificial Sequence
  Synthetic peptide
  MOD_RES (1)..(1): N-terminal acetylation
  MOD_RES (20)..(20): C-terminal amidation
FQEKGNVFVDGYFERLRAKL

SEQ ID NO: 299 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLREKL

SEQ ID NO: 300 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKANVFVDGYFERLRAKL

SEQ ID NO: 301 - protein, 20 aa, Artificial Sequence
  Synthetic peptide
  MOD_RES (1)..(1): N-terminal acetylation
  MOD_RES (20)..(20): C-terminal amidation
FQSFGNVFVDGYFERLRAKL

SEQ ID NO: 302 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVAGYFARLRAKL

SEQ ID NO: 303 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLFAKL

SEQ ID NO: 304 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRFKL

SEQ ID NO: 305 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLRAKL

SEQ ID NO: 306 - protein, 20 aa, Artificial Sequence
  Synthetic peptide
  MOD_RES (1)..(1): N-terminal acetylation
  MOD_RES (20)..(20): C-terminal amidation
FQHKGNVFVDGYFERLRAKL

SEQ ID NO: 307 - protein, 20 aa, Artificial Sequence
  Synthetic peptide
  MOD_RES (1)..(1): N-terminal acetylation
  MOD_RES (20)..(20): C-terminal amidation
FQSHGNVFVDGYFERLRAKL

SEQ ID NO: 308 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFHRLRAKL

SEQ ID NO: 309 - protein, 20 aa, Artificial Sequence
  Synthetic peptide
  MOD_RES (1)..(1): N-terminal acetylation
  MOD_RES (20)..(20): C-terminal amidation
IQSKGNVFVDGYFERLRAKL

SEQ ID NO: 310 - protein, 20 aa, Artificial Sequence
  Synthetic peptide
  MOD_RES (1)..(1): N-terminal acetylation
  MOD_RES (20)..(20): C-terminal amidation
FQIKGNVFVDGYFERLRAKL

SEQ ID NO: 311 - protein, 20 aa, Artificial Sequence
  Synthetic peptide
  MOD_RES (1)..(1): N-terminal acetylation
  MOD_RES (20)..(20): C-terminal amidation
FQSKGIVFVDGYFERLRAKL

SEQ ID NO: 312 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFIRLRAKL

SEQ ID NO: 313 - protein, 20 aa, Artificial Sequence
  Synthetic peptide
  MOD_RES (1)..(1): N-terminal acetylation
  MOD_RES (20)..(20): C-terminal amidation
FQSKGLVFVDGYFERLRAKL

SEQ ID NO: 314 - protein, 20 aa, Artificial Sequence
  Synthetic peptide
  MOD_RES (1)..(1): N-terminal acetylation
  MOD_RES (20)..(20): C-terminal amidation
FQSKGNVFVDGYLERLRAKL

SEQ ID NO: 315 - protein, 20 aa, Artificial Sequence
  Synthetic peptide
  MOD_RES (1)..(1): N-terminal acetylation
  MOD_RES (20)..(20): C-terminal amidation
FQNKGNVFVDGYFERLRAKL

SEQ ID NO: 316 - protein, 20 aa, Artificial Sequence
  Synthetic peptide
  MOD_RES (1)..(1): N-terminal acetylation
  MOD_RES (20)..(20): C-terminal amidation
FQSNGNVFVDGYFERLRAKL

SEQ ID NO: 317 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLNAKL

SEQ ID NO: 318 - protein, 20 aa, Artificial Sequence
  Synthetic peptide
  MOD_RES (1)..(1): N-terminal acetylation
  MOD_RES (20)..(20): C-terminal amidation
FQSQGNVFVDGYFERLRAKL

SEQ ID NO: 319 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRQKL

SEQ ID NO: 320 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRARL

SEQ ID NO: 321 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKR

SEQ ID NO: 322 - protein, 20 aa, Artificial Sequence
  Synthetic peptide
FQSKGNVFVDGYFSRLRAKL

SEQ ID NO: 323 - protein, 20 aa, Artificial Sequence
  Synthetic peptide
FQSKGNVFVDGYFERLTAKL

SEQ ID NO: 324 - protein, 20 aa, Artificial Sequence
  Synthetic peptide
VQSKGNVFVDGYFERLRAKL

SEQ ID NO: 325 - protein, 20 aa, Artificial Sequence
  Synthetic peptide
  MOD_RES (1)..(1): N-terminal acetylation
  MOD_RES (20)..(20): C-terminal amidation
FQVKGNVFVDGYFERLRAKL

SEQ ID NO: 326 - protein, 20 aa, Artificial Sequence
  Synthetic peptide
  MOD_RES (1)..(1): N-terminal acetylation
  MOD_RES (20)..(20): C-terminal amidation
FQSVGNVFVDGYFERLRAKL

SEQ ID NO: 327 - protein, 20 aa, Artificial Sequence
  Synthetic peptide
  MOD_RES (1)..(1): N-terminal acetylation
  MOD_RES (20)..(20): C-terminal amidation
FQSKGVVFVDGYFERLRAKL

SEQ ID NO: 328 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRVKL

SEQ ID NO: 329 - protein, 20 aa, Artificial Sequence
  Synthetic peptide
  MOD_RES (1)..(1): N-terminal acetylation
  MOD_RES (20)..(20): C-terminal amidation
WQSKGNVFVDGYFERLRAKL

SEQ ID NO: 330 - protein, 20 aa, Artificial Sequence
  Synthetic peptide
  MOD_RES (1)..(1): N-terminal acetylation
  MOD_RES (20)..(20): C-terminal amidation
FQSKGNVFVDGYWERLRAKL

SEQ ID NO: 331 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRWKL

SEQ ID NO: 332 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKW

SEQ ID NO: 333 - protein, 20 aa, Artificial Sequence
  Synthetic peptide
  MOD_RES (1)..(1): N-terminal acetylation
  MOD_RES (20)..(20): C-terminal amidation
FQSKGYVFVDGYFERLRAKL

SEQ ID NO: 334 - protein, 20 aa, Artificial Sequence
  Synthetic peptide
  MOD_RES (1)..(1): N-terminal acetylation
  MOD_RES (20)..(20): C-terminal amidation
FQSKGNYFVDGYFERLRAKL

SEQ ID NO: 335 - protein, 20 aa, Artificial Sequence
  Synthetic peptide
  MOD_RES (1)..(1): N-terminal acetylation
  MOD_RES (20)..(20): C-terminal amidation
FQSKGNVFVDGYYERLRAKL

SEQ ID NO: 336 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFYRLRAKL

SEQ ID NO: 337 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLYAKL

SEQ ID NO: 338 - protein, 20 aa, Artificial Sequence
  Synthetic peptide
  MOD_RES (1)..(1): N-terminal acetylation
  MOD_RES (5)..(5): Xaa is 2-Amino-isobutyric acid
  MOD_RES (20)..(20): C-terminal amidation
FQSKXNVFVFGYFERLRAKL

SEQ ID NO: 339 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLRAKL

SEQ ID NO: 340 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLRAKL

SEQ ID NO: 341 - protein, 20 aa, Artificial Sequence
  Synthetic peptide
  MOD_RES (1)..(1): N-terminal acetylation
  MOD_RES (20)..(20): C-terminal amidation
FQSKLNVFVDGYFERLRAKL

SEQ ID NO: 342 - protein, 20 aa, Artificial Sequence
  Synthetic peptide
  MOD_RES (1)..(1): N-terminal acetylation
  MOD_RES (20)..(20): C-terminal amidation
FQSKRNVFVDGYFERLRAKL

SEQ ID NO: 343 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLRAKL

SEQ ID NO: 344 - protein, 20 aa, Artificial Sequence
  Synthetic peptide
  MOD_RES (1)..(1): N-terminal acetylation
  MOD_RES (20)..(20): C-terminal amidation
FQSKGNVFVGGYFERLRAKL

SEQ ID NO: 345 - protein, 20 aa, Artificial Sequence
  Synthetic peptide
  MOD_RES (1)..(1): N-terminal acetylation
  MOD_RES (20)..(20): C-terminal amidation
FQSKGNVFVWGYFERLRAKL

SEQ ID NO: 346 - protein, 20 aa, Artificial Sequence
  Synthetic peptide
  MOD_RES (1)..(1): N-terminal acetylation
  MOD_RES (20)..(20): C-terminal amidation
FQSKGNVFVYGYFERLRAKL

SEQ ID NO: 347 - protein, 20 aa, Artificial Sequence
  Synthetic peptide
  MOD_RES (1)..(1): N-terminal acetylation
  MOD_RES (20)..(20): C-terminal amidation
FQSKANVFVDGYFERLAAKL

SEQ ID NO: 348 - protein, 20 aa, Artificial Sequence
  Synthetic peptide
  MOD_RES (1)..(1): N-terminal acetylation
  MOD_RES (20)..(20): C-terminal amidation
FQSRENVFVDGYFERLAAKL

SEQ ID NO: 349 - protein, 20 aa, Artificial Sequence
  Synthetic peptide
  MOD_RES (1)..(1): N-terminal acetylation
  MOD_RES (20)..(20): C-terminal amidation
FQSKDNVFVHGYFERLAAKL

SEQ ID NO: 350 - protein, 20 aa, Artificial Sequence
  Synthetic peptide
  MOD_RES (1)..(1): N-terminal acetylation
  MOD_RES (20)..(20): C-terminal amidation
FQSKERVFVDGYFERLAAKL

SEQ ID NO: 351 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLAIKL

SEQ ID NO: 352 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLAVKL

SEQ ID NO: 353 - protein, 20 aa, Artificial Sequence
  Synthetic peptide
  MOD_RES (1)..(1): N-terminal acetylation
  MOD_RES (20)..(20): C-terminal amidation
FQSRNNVFVDGYFERLAAKL

SEQ ID NO: 354 - protein, 20 aa, Artificial Sequence
  Synthetic peptide
  MOD_RES (1)..(1): N-terminal acetylation
  MOD_RES (20)..(20): C-terminal amidation
FQSRQNVFVDGYFERLAAKL

SEQ ID NO: 355 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLAAKL

SEQ ID NO: 356 - protein, 20 aa, Artificial Sequence
  Synthetic peptide
  MOD_RES (1)..(1): N-terminal acetylation
  MOD_RES (20)..(20): C-terminal amidation
FQSSKNVFVDGYFERLAAKL

SEQ ID NO: 357 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLAAKL

SEQ ID NO: 358 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLAAKL

SEQ ID NO: 359 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLAARL

SEQ ID NO: 360 - protein, 20 aa, Artificial Sequence
  Synthetic peptide
  MOD_RES (1)..(1): N-terminal acetylation
  MOD_RES (20)..(20): C-terminal amidation
FQSKHNVYVDGYFERLAAKL

SEQ ID NO: 361 - protein, 20 aa, Artificial Sequence
  Synthetic peptide
  MOD_RES (1)..(1): N-terminal acetylation
  MOD_RES (20)..(20): C-terminal amidation
FQSKYNIFVDGYFERLAAKL

SEQ ID NO: 362 - protein, 20 aa, Artificial Sequence
  Synthetic peptide
  MOD_RES (1)..(1): N-terminal acetylation
  MOD_RES (20)..(20): C-terminal amidation
FQSKNDVFVDGYFERLAAKL

SEQ ID NO: 363 - protein, 20 aa, Artificial Sequence
  Synthetic peptide
  MOD_RES (1)..(1): N-terminal acetylation
  MOD_RES (20)..(20): C-terminal amidation
FQSGGNVFVDGYFERLAAKL

SEQ ID NO: 364 - protein, 20 aa, Artificial Sequence
  Synthetic peptide
  MOD_RES (1)..(1): N-terminal acetylation
  MOD_RES (20)..(20): C-terminal amidation
FQSPKNVFVDGYFERLAAKL

SEQ ID NO: 365 - protein, 20 aa, Artificial Sequence
  Synthetic peptide
  MOD_RES (1)..(1): N-terminal acetylation
  MOD_RES (20)..(20): C-terminal amidation
FQSPKNVFVDGYFERLRAKL

SEQ ID NO: 366 - protein, 20 aa, Artificial Sequence
  Synthetic peptide
  MOD_RES (1)..(1): N-terminal acetylation
  MOD_RES (20)..(20): C-terminal amidation
FQSRKNVFVDGYFERLRAKL

SEQ ID NO: 367 - protein, 20 aa, Artificial Sequence
  Synthetic peptide
  MOD_RES (1)..(1): N-terminal acetylation
  MOD_RES (20)..(20): C-terminal amidation
FQSKKRVFVDGYFERLRAKL

SEQ ID NO: 368 - protein, 20 aa, Artificial Sequence
  Synthetic peptide
  MOD_RES (1)..(1): N-terminal acetylation
  MOD_RES (20)..(20): C-terminal amidation
FQSIKNVFVDGYFERLRAKL

SEQ ID NO: 369 - protein, 20 aa, Artificial Sequence
  Synthetic peptide
  MOD_RES (1)..(1): N-terminal acetylation
  MOD_RES (20)..(20): C-terminal amidation
CQSKGNVFVDGYFERLRAKL

SEQ ID NO: 370 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRCKL

SEQ ID NO: 371 - protein, 20 aa, Artificial Sequence
  Synthetic peptide
  MOD_RES (1)..(1): N-terminal acetylation
  MOD_RES (20)..(20): C-terminal amidation
FQSKFNVFVDGYFERLCAKL

SEQ ID NO: 372 - protein, 20 aa, Artificial Sequence
  Synthetic peptide
  MOD_RES (1)..(1): N-terminal acetylation
  MOD_RES (20)..(20): C-terminal amidation
FQSKYNVFVDGYHERLCAKL

SEQ ID NO: 373 - protein, 20 aa, Artificial Sequence
  Synthetic peptide
  MOD_RES (1)..(1): N-terminal acetylation
  MOD_RES (20)..(20): C-terminal amidation
FQSSHNVFVDGYFERLCAKL

SEQ ID NO: 374 - protein, 20 aa, Artificial Sequence
  Synthetic peptide
  MOD_RES (1)..(1): N-terminal acetylation
  MOD_RES (20)..(20): C-terminal amidation
FQSRENVFVDGYFERLCAKL

SEQ ID NO: 375 - protein, 20 aa, Artificial Sequence
  Synthetic peptide
  MOD_RES (1)..(1): N-terminal acetylation
  MOD_RES (20)..(20): C-terminal amidation
FQSCKNVFVDGYFERLRAKL

SEQ ID NO: 376 - protein, 20 aa, Artificial Sequence
  Synthetic peptide
  MOD_RES (1)..(1): N-terminal acetylation
  MOD_RES (20)..(20): C-terminal amidation
FQDPKNVFVDGYFERLCAKL

SEQ ID NO: 377 - protein, 20 aa, Artificial Sequence
  Synthetic peptide
  MOD_RES (1)..(1): N-terminal acetylation
  MOD_RES (20)..(20): C-terminal amidation
FQSKTNIFVDGYFERLCAKL

SEQ ID NO: 378 - protein, 20 aa, Artificial Sequence
  Synthetic peptide
  MOD_RES (1)..(1): N-terminal acetylation
  MOD_RES (20)..(20): C-terminal amidation
FQSHYNVFVDGYFERLCAKL

SEQ ID NO: 379 - protein, 20 aa, Artificial Sequence
  Synthetic peptide
  MOD_RES (1)..(1): N-terminal acetylation
  MOD_RES (20)..(20): C-terminal amidation
FQSRQNVFVDGYFERLCAKL

SEQ ID NO: 380 - protein, 20 aa, Artificial Sequence
  Synthetic peptide
  MOD_RES (1)..(1): N-terminal acetylation
  MOD_RES (20)..(20): C-terminal amidation
FQSSKNVFVDGYFERLCAKL

SEQ ID NO: 381 - protein, 20 aa, Artificial Sequence
  Synthetic peptide
  MOD_RES (1)..(1): N-terminal acetylation
  MOD_RES (20)..(20): C-terminal amidation
FQSHHNVFVDGYFERLCAKL

SEQ ID NO: 382 - protein, 20 aa, Artificial Sequence
  Synthetic peptide
  MOD_RES (1)..(1): N-terminal acetylation
  MOD_RES (20)..(20): C-terminal amidation
FQTKHNVFVDGYFERLCAKL

SEQ ID NO: 383 - protein, 20 aa, Artificial Sequence
  Synthetic peptide
  MOD_RES (1)..(1): N-terminal acetylation
  MOD_RES (20)..(20): C-terminal amidation
FQSKANVHVDGYFERLCAKL

SEQ ID NO: 384 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLCRKL

SEQ ID NO: 385 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLCAKL

SEQ ID NO: 386 - protein, 20 aa, Artificial Sequence
  Synthetic peptide
  MOD_RES (1)..(1): N-terminal acetylation
  MOD_RES (20)..(20): C-terminal amidation
FQSHKNVFVDGYFERLCAKL

SEQ ID NO: 387 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLCAKF

SEQ ID NO: 388 - protein, 20 aa, Artificial Sequence
  Synthetic peptide
  MOD_RES (1)..(1): N-terminal acetylation
  MOD_RES (20)..(20): C-terminal amidation
FQSKMNVFVDGYFERLCAKL

SEQ ID NO: 389 - protein, 20 aa, Artificial Sequence
  Synthetic peptide
  MOD_RES (1)..(1): N-terminal acetylation
  MOD_RES (20)..(20): C-terminal amidation
FQSAKNVFVDGYFERLCAKL

SEQ ID NO: 390 - protein, 20 aa, Artificial Sequence
  Synthetic peptide
  MOD_RES (1)..(1): N-terminal acetylation
  MOD_RES (20)..(20): C-terminal amidation
FQSKHVVFVDGYFERLCAKL

SEQ ID NO: 391 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLCARL

SEQ ID NO: 392 - protein, 20 aa, Artificial Sequence
  Synthetic peptide
  MOD_RES (1)..(1): N-terminal acetylation
  MOD_RES (20)..(20): C-terminal amidation
FQSKKHVFVDGYFERLCAKL

SEQ ID NO: 393 - protein, 20 aa, Artificial Sequence
  Synthetic peptide
  MOD_RES (1)..(1): N-terminal acetylation
  MOD_RES (20)..(20): C-terminal amidation
FQSNKNVFVDGYFERLCAKL

SEQ ID NO: 394 - protein, 20 aa, Artificial Sequence
  Synthetic peptide
  MOD_RES (1)..(1): N-terminal acetylation
  MOD_RES (20)..(20): C-terminal amidation
FQSEKNVFVDGYFERLCAKL

SEQ ID NO: 395 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLCFKL

SEQ ID NO: 396 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLSAKL

SEQ ID NO: 397 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLSAKL

SEQ ID NO: 398 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLSAKL

SEQ ID NO: 399 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLSAKL

SEQ ID NO: 400 - protein, 20 aa, Artificial Sequence
  Synthetic peptide
  MOD_RES (1)..(1): N-terminal acetylation
  MOD_RES (17)..(17): Xaa is 2-Amino-isobutyric acid
  MOD_RES (20)..(20): Xaa is 2-Amino-isobutyric acid
  MOD_RES (20)..(20): C-terminal amidation
FQSKGNVFVDGYFERLXAKX

SEQ ID NO: 401 - protein, 21 aa, Artificial Sequence
  Synthetic peptide
  MOD_RES (1)..(1): N-terminal acetylation
  DISULFID (10)..(21): Cys residues linked via disulfide bond
  MOD_RES (17)..(17): Xaa is 2-Amino-isobutyric acid
  MOD_RES (21)..(21): C-terminal amidation
FQSKGNVFVCGYFERLXAKLC

SEQ ID NO: 402 - protein, 21 aa, Artificial Sequence
  Synthetic peptide
  MOD_RES (1)..(1): N-terminal acetylation
  DISULFID (1)..(17): Cys residues linked via disulfide bond
  MOD_RES (21)..(21): C-terminal amidation
CFQSKGNVFVDGYFERLCAKL

SEQ ID NO: 403 - protein, 21 aa, Artificial Sequence
  Synthetic peptide
  MOD_RES (1)..(1): N-terminal acetylation
  DISULFID (1)..(11): Cys residues linked via disulfide bond
  MOD_RES (18)..(18): Xaa is 2-Amino-isobutyric acid
  MOD_RES (21)..(21): C-terminal amidation
CFQSKGNVFVCGYFERLXAKL

SEQ ID NO: 404 - protein, 21 aa, Artificial Sequence
  Synthetic peptide
  DISULFID (1)..(7): Cys residues linked via disulfide bond
  MOD_RES (1)..(1): N-terminal acetylation
  MOD_RES (18)..(18): Xaa is 2-Amino-isobutyric acid
  MOD_RES (21)..(21): C-terminal amidation
CFQSKGCVFVEGYFERLXAKL

SEQ ID NO: 405 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLFAKL

SEQ ID NO: 406 - protein, 22 aa, Artificial Sequence
  Synthetic peptide
  MOD_RES (1)..(1): N-terminal acetylation
  MOD_RES (22)..(22): C-terminal amidation
KKQSKKNVFVFGYFERLRAKKK

SEQ ID NO: 407 - protein, 20 aa, Artificial Sequence
  Synthetic peptide
  MOD_RES (1)..(1): N-terminal acetylation
  MOD_RES (20)..(20): C-terminal amidation
FQNKKNVFVFGYFERLRAKL

SEQ ID NO: 408 - protein, 20 aa, Artificial Sequence
  Synthetic peptide
  MOD_RES (1)..(1): N-terminal acetylation
  MOD_RES (20)..(20): C-terminal amidation
FQSKKNVFAFGYFERLRAKL

SEQ ID NO: 409 - protein, 20 aa, Artificial Sequence
  Synthetic peptide
  MOD_RES (1)..(1): N-terminal acetylation
  MOD_RES (20)..(20): C-terminal amidation
FQSKKNVFSFGYFERLRAKL

SEQ ID NO: 410 - protein, 20 aa, Artificial Sequence
  Synthetic peptide
  MOD_RES (1)..(1): N-terminal acetylation
  MOD_RES (20)..(20): C-terminal amidation
FQSKKNVFTFGYFERLRAKL

SEQ ID NO: 411 - protein, 20 aa, Artificial Sequence
  Synthetic peptide
  MOD_RES (1)..(1): N-terminal acetylation
  MOD_RES (20)..(20): C-terminal amidation
FQSKKNVFVFGYKERLRAKL

SEQ ID NO: 412 - protein, 20 aa, Artificial Sequence
  Synthetic peptide
  MOD_RES (1)..(1): N-terminal acetylation
  MOD_RES (20)..(20): C-terminal amidation
FQSKKNVFVFGYYERLRAKL

SEQ ID NO: 413 - protein, 21 aa, Artificial Sequence
  Synthetic peptide
  MOD_RES (1)..(1): N-terminal Carboxyfluorescein
  MOD_RES (1)..(1): Xaa is (13-Amino-4,7,10-trioxa-tridecayl)-succinamic acid
  MOD_RES (21)..(21): C-terminal amidation
XAFQSKKNVFVFGYFERLRAK

SEQ ID NO: 414 - protein, 20 aa, Artificial Sequence
  Synthetic peptide
  MOD_RES (1)..(1): N-terminal acetylation
  MOD_RES (20)..(20): C-terminal amidation
FQSKKNAFVFGYFERLRAKL

SEQ ID NO: 415 - protein, 20 aa, Artificial Sequence
  Synthetic peptide
  MOD_RES (1)..(1): N-terminal acetylation
  MOD_RES (20)..(20): C-terminal amidation
FQSKKNPFVFGYFERLRAKL

SEQ ID NO: 416 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAVL

SEQ ID NO: 417 - protein, 20 aa, Artificial Sequence
  Synthetic peptide
  MOD_RES (1)..(1): N-terminal acetylation
  MOD_RES (7)..(7): (S)-N-methyl-Val
  MOD_RES (20)..(20): C-terminal amidation
FQSKGNVFVFGYFERLRAKL

SEQ ID NO: 418 - protein, 20 aa, Artificial Sequence
  Synthetic peptide
  MOD_RES (1)..(1): N-terminal acetylation
  MOD_RES (10)..(10): (S)-N-methyl-Phe
  MOD_RES (20)..(20): C-terminal amidation
FQSKGNVFVFGYFERLRAKL

SEQ ID NO: 419 - protein, 20 aa, Artificial Sequence
  Synthetic peptide
  MOD_RES (1)..(1): N-terminal acetylation
  MOD_RES (20)..(20): (S)-N-methyl-Leu
  MOD_RES (20)..(20): C-terminal amidation
FQSKGNVFVFGYFERLRAKL

SEQ ID NO: 420 - protein, 20 aa, Artificial Sequence
  Synthetic peptide
  MOD_RES (1)..(1): beta-Homophenylalanine
  MOD_RES (1)..(1): N-terminal acetylation
  MOD_RES (20)..(20): C-terminal amidation
FQSKGNVFVFGYFERLRAKL

SEQ ID NO: 421 - protein, 20 aa, Artificial Sequence
  Synthetic peptide
  MOD_RES (1)..(1): N-terminal acetylation
  MOD_RES (3)..(3): beta-Homoserine
  MOD_RES (20)..(20): C-terminal amidation
FQSKGNVFVFGYFERLRAKL

SEQ ID NO: 422 - protein, 20 aa, Artificial Sequence
  Synthetic peptide
  MOD_RES (1)..(1): N-terminal acetylation
  MOD_RES (4)..(4): beta-Homolysine
  MOD_RES (20)..(20): C-terminal amidation
FQSKGNVFVFGYFERLRAKL

SEQ ID NO: 423 - protein, 21 aa, Artificial Sequence
  Synthetic peptide
  MOD_RES (1)..(1): N-terminal acetylation
  MOD_RES (19)..(19): beta-Ala
  MOD_RES (21)..(21): C-terminal amidation
FQSKGNVFVFGYFERLRAAKL

SEQ ID NO: 424 - protein, 20 aa, Artificial Sequence
  Synthetic peptide
  MOD_RES (1)..(1): N-terminal acetylation
  MOD_RES (19)..(19): beta-Homolysine
  MOD_RES (20)..(20): C-terminal amidation
FQSKGNVFVFGYFERLRAKL

SEQ ID NO: 425 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKGNVFVFGYFERLXAKL

SEQ ID NO: 426 - protein, 20 aa, Artificial Sequence
  Synthetic peptide
  MOD_RES (1)..(1): N-terminal acetylation
  MOD_RES (20)..(20): C-terminal amidation
GQSKKNVFVFGYFERLRAKL

SEQ ID NO: 427 - protein, 20 aa, Artificial Sequence
  Synthetic peptide
  MOD_RES (1)..(1): N-terminal acetylation
  MOD_RES (20)..(20): C-terminal amidation
FGSKKNVFVFGYFERLRAKL

SEQ ID NO: 428 - protein, 20 aa, Artificial Sequence
  Synthetic peptide
  MOD_RES (1)..(1): N-terminal acetylation
  MOD_RES (20)..(20): C-terminal amidation
FQGKKNVFVFGYFERLRAKL

SEQ ID NO: 429 - protein, 20 aa, Artificial Sequence
  Synthetic peptide
  MOD_RES (1)..(1): N-terminal acetylation
  MOD_RES (20)..(20): C-terminal amidation
FQSKKNGFVFGYFERLRAKL

SEQ ID NO: 430 - protein, 20 aa, Artificial Sequence
  Synthetic peptide
  MOD_RES (1)..(1): N-terminal acetylation
  MOD_RES (20)..(20): C-terminal amidation
FQSKKNVFVFGYGERLRAKL

SEQ ID NO: 431 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFGRLRAKL

SEQ ID NO: 432 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRGKL

SEQ ID NO: 433 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKG

SEQ ID NO: 434 - protein, 20 aa, Artificial Sequence
  Synthetic peptide
  MOD_RES (1)..(1): N-terminal acetylation
  MOD_RES (20)..(20): C-terminal amidation
KQSKKNVFVFGYFERLRAKL

SEQ ID NO: 435 - protein, 20 aa, Artificial Sequence
  Synthetic peptide
  MOD_RES (1)..(1): N-terminal acetylation
  MOD_RES (20)..(20): C-terminal amidation
FKSKKNVFVFGYFERLRAKL

SEQ ID NO: 436 - protein, 20 aa, Artificial Sequence
  Synthetic peptide
  MOD_RES (1)..(1): N-terminal acetylation
  MOD_RES (20)..(20): C-terminal amidation
FQSKKNVKVFGYFERLRAKL

SEQ ID NO: 437 - protein, 20 aa, Artificial Sequence
  Synthetic peptide
  MOD_RES (1)..(1): N-terminal acetylation
  MOD_RES (20)..(20): C-terminal amidation
FQSKKNVFKFGYFERLRAKL

SEQ ID NO: 438 - protein, 20 aa, Artificial Sequence
  Synthetic peptide
  MOD_RES (1)..(1): N-terminal acetylation
  MOD_RES (20)..(20): C-terminal amidation
FQSKKNVFVFKYFERLRAKL

SEQ ID NO: 439 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEKLRAKL

SEQ ID NO: 440 - protein, 20 aa, Artificial Sequence
  Synthetic peptide
  MOD_RES (1)..(1): N-terminal acetylation
  MOD_RES (20)..(20): C-terminal amidation
FQSKKNFFVFGYFERLRAKL

SEQ ID NO: 441 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFFRLRAKL

SEQ ID NO: 442 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKF

SEQ ID NO: 443 - protein, 20 aa, Artificial Sequence
  Synthetic peptide
  MOD_RES (1)..(1): N-terminal acetylation
  MOD_RES (20)..(20): C-terminal amidation
DQSKKNVFVFGYFERLRAKL

SEQ ID NO: 444 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEDLRAKL

SEQ ID NO: 445 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRDKL

SEQ ID NO: 446 - protein, 20 aa, Artificial Sequence
  Synthetic peptide
  MOD_RES (1)..(1): N-terminal acetylation
  MOD_RES (20)..(20): C-terminal amidation
FQSKKNLFVFGYFERLRAKL

SEQ ID NO: 447 - protein, 20 aa, Artificial Sequence
  Synthetic peptide
  MOD_RES (1)..(1): N-terminal acetylation
  MOD_RES (20)..(20): C-terminal amidation
FQAKKNVFVFGYFERLRAKL

SEQ ID NO: 448 - protein, 20 aa, Artificial Sequence
  Synthetic peptide
  MOD_RES (1)..(1): N-terminal acetylation
  MOD_RES (20)..(20): C-terminal amidation
FQSAKNVFVFGYFERLRAKL

SEQ ID NO: 449 - protein, 20 aa, Artificial Sequence
  Synthetic peptide
  MOD_RES (1)..(1): N-terminal acetylation
  MOD_RES (20)..(20): C-terminal amidation
FQSKANVFVFGYFERLRAKL

SEQ ID NO: 450 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLAAKL

SEQ ID NO: 451 - protein, 20 aa, Artificial Sequence
  Synthetic peptide
  MOD_RES (1)..(1): N-terminal acetylation
  MOD_RES (20)..(20): C-terminal amidation
FQPKKNVFVFGYFERLRAKL

SEQ ID NO: 452 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFPRLRAKL

SEQ ID NO: 453 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERPRAKL

SEQ ID NO: 454 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKP

SEQ ID NO: 455 - protein, 20 aa, Artificial Sequence
  Synthetic peptide
  MOD_RES (1)..(1): N-terminal acetylation
  MOD_RES (20)..(20): C-terminal amidation
FQSSKNVFVFGYFERLRAKL

SEQ ID NO: 456 - protein, 20 aa, Artificial Sequence
  Synthetic peptide
  MOD_RES (1)..(1): N-terminal acetylation
  MOD_RES (20)..(20): C-terminal amidation
FQSKKSVFVFGYFERLRAKL

SEQ ID NO: 457 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFSRLRAKL

SEQ ID NO: 458 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRSKL

SEQ ID NO: 459 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRASL

SEQ ID NO: 460 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRALL

SEQ ID NO: 461 - protein, 20 aa, Artificial Sequence
  Synthetic peptide
  MOD_RES (1)..(1): N-terminal acetylation
  MOD_RES (10)..(10): D-Phe
  MOD_RES (20)..(20): C-terminal amidation
FQSKKNVFVFGYFERLRAKL

SEQ ID NO: 462 - protein, 20 aa, Artificial Sequence
  Synthetic peptide
  MOD_RES (1)..(1): N-terminal acetylation
  MOD_RES (12)..(12): D-Tyr
  MOD_RES (20)..(20): C-terminal amidation
FQSKKNVFVFGYFERLRAKL

SEQ ID NO: 463 - protein, 20 aa, Artificial Sequence
  Synthetic peptide
  MOD_RES (1)..(1): N-terminal acetylation
  MOD_RES (14)..(14): D-Glu
  MOD_RES (20)..(20): C-terminal amidation
FQSKKNVFVFGYFERLRAKL

SEQ ID NO: 464 - protein, 20 aa, Artificial Sequence
  Synthetic peptide
  MOD_RES (1)..(1): N-terminal acetylation
  MOD_RES (15)..(15): D-Arg
  MOD_RES (20)..(20): C-terminal amidation
FQSKKNVFVFGYFERLRAKL

SEQ ID NO: 465 - protein, 20 aa, Artificial Sequence
  Synthetic peptide
  MOD_RES (1)..(1): N-terminal acetylation
  MOD_RES (17)..(17): D-Arg
  MOD_RES (20)..(20): C-terminal amidation
FQSKKNVFVFGYFERLRAKL

SEQ ID NO: 466 - protein, 20 aa, Artificial Sequence
  Synthetic peptide
  MOD_RES (1)..(1): N-terminal acetylation
  MOD_RES (1)..(1): D-Phe
  MOD_RES (2)..(2): D-Gln
  MOD_RES (3)..(3): D-Ser
  MOD_RES (4)..(4): D-Lys
  MOD_RES (5)..(5): D-Lys
  MOD_RES (6)..(6): D-Asn
  MOD_RES (7)..(7): D-Val
  MOD_RES (8)..(8): D-Phe
  MOD_RES (9)..(9): D-Val
  MOD_RES (10)..(10): D-Phe
  MOD_RES (11)..(11): D-Gly
  MOD_RES (12)..(12): D-Tyr
  MOD_RES (13)..(13): D-Phe
  MOD_RES (14)..(14): D-Glu
  MOD_RES (15)..(15): D-Arg
  MOD_RES (16)..(16): D-Leu
  MOD_RES (17)..(17): D-Arg
  MOD_RES (18)..(18): D-Ala
  MOD_RES (19)..(19): D-Lys
  MOD_RES (20)..(20): D-Leu
  MOD_RES (20)..(20): C-terminal amidation
FQSKKNVFVFGYFERLRAKL

SEQ ID NO: 467 - protein, 20 aa, Artificial Sequence
  Synthetic peptide
  MOD_RES (1)..(1): N-terminal acetylation
  MOD_RES (1)..(1): D-Leu
  MOD_RES (2)..(2): D-Lys
  MOD_RES (3)..(3): D-Ala
  MOD_RES (4)..(4): D-Arg
  MOD_RES (5)..(5): D-Leu
  MOD_RES (6)..(6): D-Arg
  MOD_RES (7)..(7): D-Glu
  MOD_RES (8)..(8): D-Phe
  MOD_RES (9)..(9): D-Tyr
  MOD_RES (10)..(10): D-Gly
  MOD_RES (11)..(11): D-Phe
  MOD_RES (12)..(12): D-Val
  MOD_RES (13)..(13): D-Phe
  MOD_RES (14)..(14): D-Val
  MOD_RES (15)..(15): D-Asn
  MOD_RES (16)..(16): D-Lys
  MOD_RES (17)..(17): D-Lys
  MOD_RES (18)..(18): D-Ser
  MOD_RES (19)..(19): D-Gln
  MOD_RES (20)..(20): D-Phe
  MOD_RES (20)..(20): C-terminal amidation
LKARLREFYGFVFVNKKSQF

SEQ ID NO: 468 - protein, 20 aa, Artificial Sequence
  Synthetic peptide
  MOD_RES (1)..(1): N-terminal acetylation
  MOD_RES (15)..(15): omega-methyl-Arg
  MOD_RES (20)..(20): C-terminal amidation
FQSKKNVFVFGYFERLRAKL

SEQ ID NO: 469 - protein, 20 aa, Artificial Sequence
  Synthetic peptide
  MOD_RES (1)..(1): N-terminal acetylation
  MOD_RES (20)..(20): C-terminal amidation
AQSKGNVFVDGYFERLRAKL

SEQ ID NO: 470 - protein, 20 aa, Artificial Sequence
  Synthetic peptide
  MOD_RES (1)..(1): N-terminal acetylation
  MOD_RES (20)..(20): C-terminal amidation
FASKGNVFVDGYFERLRAKL

SEQ ID NO: 471 - protein, 20 aa, Artificial Sequence
  Synthetic peptide
  MOD_RES (1)..(1): N-terminal acetylation
  MOD_RES (20)..(20): C-terminal amidation
FQSKGNAFVDGYFERLRAKL

SEQ ID NO: 472 - protein, 20 aa, Artificial Sequence
  Synthetic peptide
  MOD_RES (1)..(1): N-terminal acetylation
  MOD_RES (20)..(20): C-terminal amidation
FQSKGNVFVDGYAERLRAKL

SEQ ID NO: 473 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEALRAKL

SEQ ID NO: 474 - protein, 20 aa, Artificial Sequence
  Synthetic peptide
  MOD_RES (1)..(1): N-terminal acetylation
  MOD_RES (20)..(20): C-terminal amidation
FQDKGNVFVDGYFERLRAKL

SEQ ID NO: 475 - protein, 20 aa, Artificial Sequence
  Synthetic peptide
  MOD_RES (1)..(1): N-terminal acetylation
  MOD_RES (20)..(20): C-terminal amidation
FQSKGDVFVDGYFERLRAKL

SEQ ID NO: 476 - protein, 20 aa, Artificial Sequence
  Synthetic peptide
  MOD_RES (1)..(1): N-terminal acetylation
  MOD_RES (20)..(20): C-terminal amidation
FQSKGNVFVDGDFERLRAKL

SEQ ID NO: 477 - protein, 20 aa, Artificial Sequence
  Synthetic peptide
  MOD_RES (1)..(1): N-terminal acetylation
  MOD_RES (20)..(20): C-terminal amidation
FQSKGNVFVDGYDERLRAKL

SEQ ID NO: 478 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLDAKL

SEQ ID NO: 479 - protein, 20 aa, Artificial Sequence
  Synthetic peptide
  MOD_RES (1)..(1): N-terminal acetylation
  MOD_RES (20)..(20): C-terminal amidation
EQSKGNVFVDGYFERLRAKL

SEQ ID NO: 480 - protein, 20 aa, Artificial Sequence
  Synthetic peptide
  MOD_RES (1)..(1): N-terminal acetylation
  MOD_RES (20)..(20): C-terminal amidation
FQSKGEVFVDGYFERLRAKL

SEQ ID NO: 481 - protein, 20 aa, Artificial Sequence
  Synthetic peptide
  MOD_RES (1)..(1): N-terminal acetylation
  MOD_RES (20)..(20): C-terminal amidation
FQSKGNEFVDGYFERLRAKL

SEQ ID NO: 482 - protein, 20 aa, Artificial Sequence
  Synthetic peptide
  MOD_RES (1)..(1): N-terminal acetylation
  MOD_RES (20)..(20): C-terminal amidation
FQSKGNVFVDGYEERLRAKL

SEQ ID NO: 483 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEELRAKL

SEQ ID NO: 484 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLEAKL

SEQ ID NO: 485 - protein, 20 aa, Artificial Sequence
  Synthetic peptide
  MOD_RES (1)..(1): N-terminal acetylation
  MOD_RES (20)..(20): C-terminal amidation
FFSKGNVFVDGYFERLRAKL

SEQ ID NO: 486 - protein, 20 aa, Artificial Sequence
  Synthetic peptide
  MOD_RES (1)..(1): N-terminal acetylation
  MOD_RES (20)..(20): C-terminal amidation
FQFKGNVFVDGYFERLRAKL

SEQ ID NO: 487 - protein, 20 aa, Artificial Sequence
  Synthetic peptide
  MOD_RES (1)..(1): N-terminal acetylation
  MOD_RES (20)..(20): C-terminal amidation
FQSKGFVFVDGYFERLRAKL

SEQ ID NO: 488 - protein, 20 aa, Artificial Sequence
  Synthetic peptide
  MOD_RES (1)..(1): N-terminal acetylation
  MOD_RES (20)..(20): C-terminal amidation
FQSKGNFFVDGYFERLRAKL

SEQ ID NO: 489 - protein, 20 aa, Artificial Sequence
  Synthetic peptide
  MOD_RES (1)..(1): N-terminal acetylation
  MOD_RES (20)..(20): C-terminal amidation
FQSKGNVFFDGYFERLRAKL

SEQ ID NO: 490 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is (S)-Norleucine
  MOD_RES (20)..(20): C-terminal amidation
FQSKAAVFVAGYFARLXAKL

SEQ ID NO: 491 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFFRLRAKL

SEQ ID NO: 492 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEFLRAKL

SEQ ID NO: 493 - protein, 20 aa, Artificial Sequence
  Synthetic peptide
  MOD_RES (1)..(1): N-terminal acetylation
  MOD_RES (20)..(20): C-terminal amidation
FGSKGNVFVDGYFERLRAKL

SEQ ID NO: 494 - protein, 20 aa, Artificial Sequence
  Synthetic peptide
  MOD_RES (1)..(1): N-terminal acetylation
  MOD_RES (20)..(20): C-terminal amidation
FQGKGNVFVDGYFERLRAKL

SEQ ID NO: 495 - protein, 20 aa, Artificial Sequence
  Synthetic peptide
  MOD_RES (1)..(1): N-terminal acetylation
  MOD_RES (20)..(20): C-terminal amidation
FQSGGNVFVDGYFERLRAKL

SEQ ID NO: 496 - protein, 20 aa, Artificial Sequence
  Synthetic peptide
  MOD_RES (1)..(1): N-terminal acetylation
  MOD_RES (20)..(20): C-terminal amidation
FQSKGGVFVDGYFERLRAKL

SEQ ID NO: 497 - protein, 20 aa, Artificial Sequence
  Synthetic peptide
  MOD_RES (1)..(1): N-terminal acetylation
  MOD_RES (20)..(20): C-terminal amidation
FQSKGNVFVDGYGERLRAKL

SEQ ID NO: 498 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFGRLRAKL

SEQ ID NO: 499 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEGLRAKL

SEQ ID NO: 500 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLGAKL

SEQ ID NO: 501 - protein, 20 aa, Artificial Sequence
  Synthetic peptide
  MOD_RES (1)..(1): N-terminal acetylation
  MOD_RES (20)..(20): C-terminal amidation
HQSKGNVFVDGYFERLRAKL

SEQ ID NO: 502 - protein, 20 aa, Artificial Sequence
  Synthetic peptide
  MOD_RES (1)..(1): N-terminal acetylation
  MOD_RES (20)..(20): C-terminal amidation
FQSKGHVFVDGYFERLRAKL

SEQ ID NO: 503 - protein, 20 aa, Artificial Sequence
  Synthetic peptide
  MOD_RES (1)..(1): N-terminal acetylation
  MOD_RES (20)..(20): C-terminal amidation
FQSKGNHFVDGYFERLRAKL

SEQ ID NO: 504 - protein, 20 aa, Artificial Sequence
  Synthetic peptide
  MOD_RES (1)..(1): N-terminal acetylation
  MOD_RES (20)..(20): C-terminal amidation
FQSKGNVFVDHYFERLRAKL

SEQ ID NO: 505 - protein, 20 aa, Artificial Sequence
  Synthetic peptide
  MOD_RES (1)..(1): N-terminal acetylation
  MOD_RES (20)..(20): C-terminal amidation
FQSKGNVFVDGYHERLRAKL

SEQ ID NO: 506 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRHKL

SEQ ID NO: 507 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKH

SEQ ID NO: 508 - protein, 20 aa, Artificial Sequence
  Synthetic peptide
  MOD_RES (1)..(1): N-terminal acetylation
  MOD_RES (20)..(20): C-terminal amidation
FISKGNVFVDGYFERLRAKL

SEQ ID NO: 509 - protein, 20 aa, Artificial Sequence
  Synthetic peptide
  MOD_RES (1)..(1): N-terminal acetylation
  MOD_RES (20)..(20): C-terminal amidation
FQSKGNVFIDGYFERLRAKL

SEQ ID NO: 510 - protein, 20 aa, Artificial Sequence
  Synthetic peptide
  MOD_RES (1)..(1): N-terminal acetylation
  MOD_RES (20)..(20): C-terminal amidation
FQSKGNVFVDGYIERLRAKL

SEQ ID NO: 511 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRIKL

SEQ ID NO: 512 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKI

SEQ ID NO: 513 - protein, 20 aa, Artificial Sequence
  Synthetic peptide
  MOD_RES (1)..(1): N-terminal acetylation
  MOD_RES (20)..(20): C-terminal amidation
KQSKGNVFVDGYFERLRAKL

SEQ ID NO: 514 - protein, 20 aa, Artificial Sequence
  Synthetic peptide
  MOD_RES (1)..(1): N-terminal acetylation
  MOD_RES (20)..(20): C-terminal amidation
FQKKGNVFVDGYFERLRAKL

SEQ ID NO: 515 - protein, 20 aa, Artificial Sequence
  Synthetic peptide
  MOD_RES (1)..(1): N-terminal acetylation
  MOD_RES (20)..(20): C-terminal amidation
FQSKGNVFKDGYFERLRAKL

SEQ ID NO: 516 - protein, 20 aa, Artificial Sequence
  Synthetic peptide
  MOD_RES (1)..(1): N-terminal acetylation
  MOD_RES (20)..(20): C-terminal amidation
FQSKGNVFVDGYKERLRAKL

SEQ ID NO: 517 - protein, 20 aa, Artificial Sequence
  Synthetic peptide
  MOD_RES (1)..(1): N-terminal acetylation
  MOD_RES (20)..(20): C-terminal amidation
LQSKGNVFVDGYFERLRAKL

SEQ ID NO: 518 - protein, 20 aa, Artificial Sequence
  Synthetic peptide
  MOD_RES (1)..(1): N-terminal acetylation
  MOD_RES (20)..(20): C-terminal amidation
FQLKGNVFVDGYFERLRAKL

SEQ ID NO: 519 - protein, 20 aa, Artificial Sequence
  Synthetic peptide
  MOD_RES (1)..(1): N-terminal acetylation
  MOD_RES (20)..(20): C-terminal amidation
FQSKGNLFVDGYFERLRAKL

SEQ ID NO: 520 - protein, 20 aa, Artificial Sequence
  Synthetic peptide
  MOD_RES (1)..(1): N-terminal acetylation
  MOD_RES (20)..(20): C-terminal amidation
FQSKGNVFVDLYFERLRAKL

SEQ ID NO: 521 - protein, 20 aa, Artificial Sequence
  Synthetic peptide
  MOD_RES (1)..(1): N-terminal acetylation
  MOD_RES (20)..(20): C-terminal amidation
FQSKGNVFVDGLFERLRAKL

SEQ ID NO: 522 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFELLRAKL

SEQ ID NO: 523 - protein, 20 aa, Artificial Sequence
  Synthetic peptide
  MOD_RES (1)..(1): N-terminal acetylation
  MOD_RES (20)..(20): C-terminal amidation
FQSKGNVFVDGYMERLRAKL

SEQ ID NO: 524 - protein, 20 aa, Artificial Sequence
  Synthetic peptide
  MOD_RES (1)..(1): N-terminal acetylation
  MOD_RES (20)..(20): C-terminal amidation
NQSKGNVFVDGYFERLRAKL

SEQ ID NO: 525 - protein, 20 aa, Artificial Sequence
  Synthetic peptide
  MOD_RES (1)..(1): N-terminal acetylation
  MOD_RES (20)..(20): C-terminal amidation
FNSKGNVFVDGYFERLRAKL

SEQ ID NO: 526 - protein, 20 aa, Artificial Sequence
  Synthetic peptide
  MOD_RES (1)..(1): N-terminal acetylation
  MOD_RES (20)..(20): C-terminal amidation
FQSKGNVFVDGYNERLRAKL

SEQ ID NO: 527 - protein, 20 aa, Artificial Sequence
  Synthetic peptide
  MOD_RES (1)..(1): N-terminal acetylation
  MOD_RES (20)..(20): C-terminal amidation
FQSKGNPFVDGYFERLRAKL

SEQ ID NO: 528 - protein, 20 aa, Artificial Sequence
  Synthetic peptide
  MOD_RES (1)..(1): N-terminal acetylation
  MOD_RES (20)..(20): C-terminal amidation
FQSKGNVFVDPYFERLRAKL

SEQ ID NO: 529 - protein, 20 aa, Artificial Sequence
  Synthetic peptide
  MOD_RES (1)..(1): N-terminal acetylation
  MOD_RES (20)..(20): C-terminal amidation
FQSKGNVFVDGYPERLRAKL

SEQ ID NO: 530 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFPRLRAKL

SEQ ID NO: 531 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEPLRAKL

SEQ ID NO: 532 - protein, 20 aa, Artificial Sequence
  Synthetic peptide
  MOD_RES (1)..(1): N-terminal acetylation
  MOD_RES (20)..(20): C-terminal amidation
QQSKGNVFVDGYFERLRAKL

SEQ ID NO: 533 - protein, 20 aa, Artificial Sequence
  Synthetic peptide
  MOD_RES (1)..(1): N-terminal acetylation
  MOD_RES (20)..(20): C-terminal amidation
FQSKGNQFVDGYFERLRAKL

SEQ ID NO: 534 - protein, 20 aa, Artificial Sequence
  Synthetic peptide
  MOD_RES (1)..(1): N-terminal acetylation
  MOD_RES (20)..(20): C-terminal amidation
FQSKGNVFQDGYFERLRAKL

SEQ ID NO: 535 - protein, 20 aa, Artificial Sequence
  Synthetic peptide
  MOD_RES (1)..(1): N-terminal acetylation
  MOD_RES (20)..(20): C-terminal amidation
FQSKGNVFVDQYFERLRAKL

SEQ ID NO: 536 - protein, 20 aa, Artificial Sequence
  Synthetic peptide
  MOD_RES (1)..(1): N-terminal acetylation
  MOD_RES (20)..(20): C-terminal amidation
FQSKGNVFVDGYQERLRAKL

SEQ ID NO: 537 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEQLRAKL

SEQ ID NO: 538 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLQAKL

SEQ ID NO: 539 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKQ

SEQ ID NO: 540 - protein, 20 aa, Artificial Sequence
  Synthetic peptide
  MOD_RES (1)..(1): N-terminal acetylation
  MOD_RES (20)..(20): C-terminal amidation
RQSKGNVFVDGYFERLRAKL

SEQ ID NO: 541 - protein, 20 aa, Artificial Sequence
  Synthetic peptide
  MOD_RES (1)..(1): N-terminal acetylation
  MOD_RES (20)..(20): C-terminal amidation
FRSKGNVFVDGYFERLRAKL

SEQ ID NO: 542 - protein, 20 aa, Artificial Sequence
  Synthetic peptide
  MOD_RES (1)..(1): N-terminal acetylation
  MOD_RES (20)..(20): C-terminal amidation
FQSKGNRFVDGYFERLRAKL

SEQ ID NO: 543 - protein, 20 aa, Artificial Sequence
  Synthetic peptide
  MOD_RES (1)..(1): N-terminal acetylation
  MOD_RES (20)..(20): C-terminal amidation
FQSKGNVRVDGYFERLRAKL

SEQ ID NO: 544 - protein, 20 aa, Artificial Sequence
  Synthetic peptide
  MOD_RES (1)..(1): N-terminal acetylation
  MOD_RES (20)..(20): C-terminal amidation
FQSKGNVFRDGYFERLRAKL

SEQ ID NO: 545 - protein, 20 aa, Artificial Sequence
  Synthetic peptide
  MOD_RES (1)..(1): N-terminal acetylation
  MOD_RES (20)..(20): C-terminal amidation
FQSKGNVFVDGYRERLRAKL

SEQ ID NO: 546 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERRRAKL

SEQ ID NO: 547 - protein, 20 aa, Artificial Sequence
  Synthetic peptide
  MOD_RES (1)..(1): N-terminal acetylation
  MOD_RES (20)..(20): C-terminal amidation
FSSKGNVFVDGYFERLRAKL

SEQ ID NO: 548 - protein, 20 aa, Artificial Sequence
  Synthetic peptide
  MOD_RES (1)..(1): N-terminal acetylation
  MOD_RES (20)..(20): C-terminal amidation
FQSSGNVFVDGYFERLRAKL

SEQ ID NO: 549 - protein, 20 aa, Artificial Sequence
  Synthetic peptide
  MOD_RES (1)..(1): N-terminal acetylation
  MOD_RES (20)..(20): C-terminal amidation
FQSKGNSFVDGYFERLRAKL

SEQ ID NO: 550 - protein, 20 aa, Artificial Sequence
  Synthetic peptide
  MOD_RES (1)..(1): N-terminal acetylation
  MOD_RES (20)..(20): C-terminal amidation
FQSKGNVFSDGYFERLRAKL

SEQ ID NO: 551 - protein, 20 aa, Artificial Sequence
  Synthetic peptide
  MOD_RES (1)..(1): N-terminal acetylation
  MOD_RES (20)..(20): C-terminal amidation
FQSKGNVFVDSYFERLRAKL

SEQ ID NO: 552 - protein, 20 aa, Artificial Sequence
  Synthetic peptide
  MOD_RES (1)..(1): N-terminal acetylation
  MOD_RES (20)..(20): C-terminal amidation
FQSKGNVFVDGYSERLRAKL

SEQ ID NO: 553 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLSAKL

SEQ ID NO: 554 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRSKL

SEQ ID NO: 555 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKS

SEQ ID NO: 556 - protein, 20 aa, Artificial Sequence
  Synthetic peptide
  MOD_RES (1)..(1): N-terminal acetylation
  MOD_RES (20)..(20): C-terminal amidation
TQSKGNVFVDGYFERLRAKL

SEQ ID NO: 557 - protein, 20 aa, Artificial Sequence
  Synthetic peptide
  MOD_RES (1)..(1): N-terminal acetylation
  MOD_RES (20)..(20): C-terminal amidation
FQTKGNVFVDGYFERLRAKL

SEQ ID NO: 558 - protein, 20 aa, Artificial Sequence
  Synthetic peptide
  MOD_RES (1)..(1): N-terminal acetylation
  MOD_RES (20)..(20): C-terminal amidation
FQSTGNVFVDGYFERLRAKL

SEQ ID NO: 559 - protein, 20 aa, Artificial Sequence
  Synthetic peptide
  MOD_RES (1)..(1): N-terminal acetylation
  MOD_RES (20)..(20): C-terminal amidation
FQSKGTVFVDGYFERLRAKL

SEQ ID NO: 560 - protein, 20 aa, Artificial Sequence
  Synthetic peptide
  MOD_RES (1)..(1): N-terminal acetylation
  MOD_RES (20)..(20): C-terminal amidation
FQSKGNTFVDGYFERLRAKL

SEQ ID NO: 561 - protein, 20 aa, Artificial Sequence
  Synthetic peptide
  MOD_RES (1)..(1): N-terminal acetylation
  MOD_RES (20)..(20): C-terminal amidation
FQSKGNVFTDGYFERLRAKL

SEQ ID NO: 562 - protein, 20 aa, Artificial Sequence
  Synthetic peptide
  MOD_RES (1)..(1): N-terminal acetylation
  MOD_RES (20)..(20): C-terminal amidation
FQSKGNVFVDGYTERLRAKL

SEQ ID NO: 563 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRTKL

SEQ ID NO: 564 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKT

SEQ ID NO: 565 - protein, 20 aa, Artificial Sequence
  Synthetic peptide
  MOD_RES (1)..(1): N-terminal acetylation
  MOD_RES (5)..(5): D-Ala
  MOD_RES (20)..(20): C-terminal amidation
FQSKAAVFVFGYFARLRAKL

SEQ ID NO: 566 - protein, 20 aa, Artificial Sequence
  Synthetic peptide
  MOD_RES (1)..(1): N-terminal acetylation
  MOD_RES (20)..(20): C-terminal amidation
FQSKGNVFVDGYVERLRAKL

SEQ ID NO: 567 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERVRAKL

SEQ ID NO: 568 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKV

SEQ ID NO: 569 - protein, 20 aa, Artificial Sequence
  Synthetic peptide
  MOD_RES (1)..(1): N-terminal acetylation
  MOD_RES (20)..(20): C-terminal amidation
FQWKGNVFVDGYFERLRAKL

SEQ ID NO: 570 - protein, 20 aa, Artificial Sequence
  Synthetic peptide
  MOD_RES (1)..(1): N-terminal acetylation
  MOD_RES (20)..(20): C-terminal amidation
FQSKGWVFVDGYFERLRAKL

SEQ ID NO: 571 - protein, 20 aa, Artificial Sequence
  Synthetic peptide
  MOD_RES (1)..(1): N-terminal acetylation
  MOD_RES (20)..(20): C-terminal amidation
FQSKGNWFVDGYFERLRAKL

SEQ ID NO: 572 - protein, 20 aa, Artificial Sequence
  Synthetic peptide
  MOD_RES (1)..(1): N-terminal acetylation
  MOD_RES (20)..(20): C-terminal amidation
FQSKGNVWVDGYFERLRAKL

SEQ ID NO: 573 - protein, 20 aa, Artificial Sequence
  Synthetic peptide
  MOD_RES (1)..(1): N-terminal acetylation
  MOD_RES (20)..(20): C-terminal amidation
FQSKGNVFWDGYFERLRAKL

SEQ ID NO: 574 - protein, 20 aa, Artificial Sequence
  Synthetic peptide
  MOD_RES (1)..(1): N-terminal acetylation
  MOD_RES (20)..(20): C-terminal amidation
FQSKGNVFVDWYFERLRAKL

SEQ ID NO: 575 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERWRAKL

SEQ ID NO: 576 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLWAKL

SEQ ID NO: 577 - protein, 20 aa, Artificial Sequence
  Synthetic peptide
  MOD_RES (1)..(1): N-terminal acetylation
  MOD_RES (20)..(20): C-terminal amidation
FQYKGNVFVDGYFERLRAKL

SEQ ID NO: 578 - protein, 20 aa, Artificial Sequence
  Synthetic peptide
  MOD_RES (1)..(1): N-terminal acetylation
  MOD_RES (20)..(20): C-terminal amidation
FQSKGNVFYDGYFERLRAKL

SEQ ID NO: 579 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRYKL

SEQ ID NO: 580 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKY

SEQ ID NO: 581 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLRAKL

SEQ ID NO: 582 - protein, 20 aa, Artificial Sequence
  Synthetic peptide
  MOD_RES (1)..(1): N-terminal acetylation
  MOD_RES (20)..(20): C-terminal amidation
FQSKINVFVDGYFERLRAKL

SEQ ID NO: 583 - protein, 20 aa, Artificial Sequence
  Synthetic peptide
  MOD_RES (1)..(1): N-terminal acetylation
  MOD_RES (20)..(20): C-terminal amidation
FQSKPNVFVDGYFERLRAKL

SEQ ID NO: 584 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLRAKL

SEQ ID NO: 585 - protein, 20 aa, Artificial Sequence
  Synthetic peptide
  MOD_RES (1)..(1): N-terminal acetylation
  MOD_RES (20)..(20): C-terminal amidation
FQSKTNVFVDGYFERLRAKL

SEQ ID NO: 586 - protein, 20 aa, Artificial Sequence
  Synthetic peptide
  MOD_RES (1)..(1): N-terminal acetylation
  MOD_RES (20)..(20): C-terminal amidation
FQSKVNVFVDGYFERLRAKL

SEQ ID NO: 587 - protein, 20 aa, Artificial Sequence
  Synthetic peptide
  MOD_RES (1)..(1): N-terminal acetylation
  MOD_RES (20)..(20): C-terminal amidation
FQSKWNVFVDGYFERLRAKL

SEQ ID NO: 588 - protein, 20 aa, Artificial Sequence
  Synthetic peptide
  MOD_RES (1)..(1): N-terminal acetylation
  MOD_RES (20)..(20): C-terminal amidation
FQSKGNVFVIGYFERLRAKL

SEQ ID NO: 589 - protein, 20 aa, Artificial Sequence
  Synthetic peptide
  MOD_RES (1)..(1): N-terminal acetylation
  MOD_RES (20)..(20): C-terminal amidation
FQSKGNVFVLGYFERLRAKL

SEQ ID NO: 590 - protein, 20 aa, Artificial Sequence
  Synthetic peptide
  MOD_RES (1)..(1): N-terminal acetylation
  MOD_RES (20)..(20): C-terminal amidation
FQSKGNVFVQGYFERLRAKL

SEQ ID NO: 591 - protein, 20 aa, Artificial Sequence
  Synthetic peptide
  MOD_RES (1)..(1): N-terminal acetylation
  MOD_RES (20)..(20): C-terminal amidation
FQSKFNVFVDGYFERLAAKL

SEQ ID NO: 592 - protein, 20 aa, Artificial Sequence
  Synthetic peptide
  MOD_RES (1)..(1): N-terminal acetylation
  MOD_RES (20)..(20): C-terminal amidation
FQSKYNVFVDGYHERLAAKL

SEQ ID NO: 593 - protein, 20 aa, Artificial Sequence
  Synthetic peptide
  MOD_RES (1)..(1): N-terminal acetylation
  MOD_RES (20)..(20): C-terminal amidation
FQSSHNVFVDGYFERLAAKL

SEQ ID NO: 594 - protein, 20 aa, Artificial Sequence
  Synthetic peptide
  MOD_RES (1)..(1): N-terminal acetylation
  MOD_RES (20)..(20): C-terminal amidation
FQSAKNVFVDGYFERLRAKL

SEQ ID NO: 595 - protein, 20 aa, Artificial Sequence
  Synthetic peptide
  MOD_RES (1)..(1): N-terminal acetylation
  MOD_RES (20)..(20): C-terminal amidation
FQSFKNVFVDGYFERLAAKL

SEQ ID NO: 596 - protein, 20 aa, Artificial Sequence
  Synthetic peptide
  MOD_RES (1)..(1): N-terminal acetylation
  MOD_RES (20)..(20): C-terminal amidation
FQDPKNVFVDGYFERLAAKL

SEQ ID NO: 597 - protein, 20 aa, Artificial Sequence
  Synthetic peptide
  MOD_RES (1)..(1): N-terminal acetylation
  MOD_RES (20)..(20): C-terminal amidation
FQSKVNVFVDGYFERLAAKL

SEQ ID NO: 598 - protein, 20 aa, Artificial Sequence
  Synthetic peptide
  MOD_RES (1)..(1): N-terminal acetylation
  MOD_RES (20)..(20): C-terminal amidation
FQSIKNVFVDGYFERLAAKL

SEQ ID NO: 599 - protein, 20 aa, Artificial Sequence
  Synthetic peptide
  MOD_RES (1)..(1): N-terminal acetylation
  MOD_RES (20)..(20): C-terminal amidation
FQSKTNIFVDGYFERLAAKL

SEQ ID NO: 600 - protein, 20 aa, Artificial Sequence
  Synthetic peptide
  MOD_RES (1)..(1): N-terminal acetylation
  MOD_RES (20)..(20): C-terminal amidation
FQSHYNVFVDGYFERLAAKL

SEQ ID NO: 601 - protein, 20 aa, Artificial Sequence
  Synthetic peptide
  MOD_RES (1)..(1): N-terminal acetylation
  MOD_RES (20)..(20): C-terminal amidation
FQSKENVFVDGYFDRLAAKL

SEQ ID NO: 602 - protein, 20 aa, Artificial Sequence
  Synthetic peptide
  MOD_RES (1)..(1): N-terminal acetylation
  MOD_RES (20)..(20): C-terminal amidation
FQSHHNVFVDGYFERLAAKL

SEQ ID NO: 603 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLAAKL

SEQ ID NO: 604 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLAFKL

SEQ ID NO: 605 - protein, 20 aa, Artificial Sequence
  Synthetic peptide
  MOD_RES (1)..(1): N-terminal acetylation
  MOD_RES (20)..(20): C-terminal amidation
FQSFKHVFVDGYFERLAAKL

SEQ ID NO: 606 - protein, 20 aa, Artificial Sequence
  Synthetic peptide
  MOD_RES (1)..(1): N-terminal acetylation
  MOD_RES (20)..(20): C-terminal amidation
FQSKANVHVDGYFERLAAKL

SEQ ID NO: 607 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLAAKL

SEQ ID NO: 608 - protein, 20 aa, Artificial Sequence
  Synthetic peptide
  MOD_RES (1)..(1): N-terminal acetylation
  MOD_RES (20)..(20): C-terminal amidation
FQSHKNVFVDGYFERLAAKL

SEQ ID NO: 609 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFERLAAKF

SEQ ID NO: 610 - protein, 20 aa, Artificial Sequence
  Synthetic peptide
  MOD_RES (1)..(1): N-terminal acetylation
  MOD_RES (20)..(20): C-terminal amidation
FQSKMNVFVDGYFERLAAKL

SEQ ID NO: 611 - protein, 20 aa, Artificial Sequence
  Synthetic peptide
  MOD_RES (1)..(1): N-terminal acetylation
  MOD_RES (20)..(20): C-terminal amidation
FQSAYNVFVDGYFERLAAKL

SEQ ID NO: 612 - protein, 20 aa, Artificial Sequence
  Synthetic peptide
  MOD_RES (1)..(1): N-terminal acetylation
  MOD_RES (20)..(20): C-terminal amidation
FQSKGNWFVDGYFERLAAKL

SEQ ID NO: 613 - protein, 20 aa, Artificial Sequence
  Synthetic peptide
  MOD_RES (1)..(1): N-terminal acetylation
  MOD_RES (20)..(20): C-terminal amidation
FQSAKNVFVDGYFVRLRAKL

SEQ ID NO: 614 - protein, 20 aa, Artificial Sequence
  Synthetic peptide
  MOD_RES (1)..(1): N-terminal acetylation
  MOD_RES (20)..(20): C-terminal amidation
FQSKTNVFVDGYFERLAAKL

SEQ ID NO: 615 - protein, 20 aa, Artificial Sequence
  Synthetic peptide
  MOD_RES (1)..(1): N-terminal acetylation
  MOD_RES (20)..(20): C-terminal amidation
FQSKHVVFVDGYFERLAAKL

SEQ ID NO: 616 - protein, 20 aa, Artificial Sequence
  Synthetic peptide
  MOD_RES (1)..(1): N-terminal acetylation
  MOD_RES (20)..(20): C-terminal amidation
FQSKKHVFVDGYFERLAAKL

SEQ ID NO: 617 - protein, 20 aa, Artificial Sequence
  Synthetic peptide
  MOD_RES (1)..(1): N-terminal acetylation
  MOD_RES (20)..(20): C-terminal amidation
FQSDKNVFVDGYFERLAAKL

SEQ ID NO: 618 - protein, 20 aa, Artificial Sequence
  Synthetic peptide
  MOD_RES (1)..(1): N-terminal acetylation
  MOD_RES (20)..(20): C-terminal amidation
FQSNKNVFVDGYFERLAAKL

SEQ ID NO: 619 - protein, 20 aa, Artificial Sequence
  Synthetic peptide
  MOD_RES (1)..(1): N-terminal acetylation
  MOD_RES (20)..(20): C-terminal amidation
FQSHKNVFVEGYFERLAAKL

SEQ ID NO: 620 - protein, 20 aa, Artificial Sequence
  Synthetic peptide
  MOD_RES (1)..(1): N-terminal acetylation
  MOD_RES (20)..(20): C-terminal amidation
FQSYKDVFVDGYFERLATKL

SEQ ID NO: 621 - protein, 20 aa, Artificial Sequence
  Synthetic peptide
  MOD_RES (1)..(1): N-terminal acetylation
  MOD_RES (20)..(20): C-terminal amidation
FQSKNNFFVDGYFERLAARL

SEQ ID NO: 622 - protein, 20 aa, Artificial Sequence
  Synthetic peptide
  MOD_RES (1)..(1): N-terminal acetylation
  MOD_RES (20)..(20): C-terminal amidation
FQSEQNVFVDGYFERLAAKL

SEQ ID NO: 623 - protein, 20 aa, Artificial Sequence
  Synthetic peptide
  MOD_RES (1)..(1): N-terminal acetylation
  MOD_RES (20)..(20): C-terminal amidation
FQSEHNVFVDGYFERLAAKL

SEQ ID NO: 624 - protein, 20 aa, Artificial Sequence
  Synthetic peptide
  MOD_RES (1)..(1): N-terminal acetylation
  MOD_RES (20)..(20): C-terminal amidation
FQSEKNVFVDGYFERLAAKL

SEQ ID NO: 625 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLAFKL

SEQ ID NO: 626 - protein, 20 aa, Artificial Sequence
  Synthetic peptide
  MOD_RES (1)..(1): N-terminal acetylation
  MOD_RES (20)..(20): C-terminal amidation
FQSKRNVFVDGYFERLAAKL

SEQ ID NO: 627 - protein, 20 aa, Artificial Sequence
  Synthetic peptide
  MOD_RES (1)..(1): N-terminal acetylation
  MOD_RES (20)..(20): C-terminal amidation
FQSGKNVFVDGYFERLAAKL

SEQ ID NO: 628 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLFAKL

SEQ ID NO: 629 - protein, 20 aa, Artificial Sequence
  Synthetic peptide
  MOD_RES (1)..(1): N-terminal acetylation
  MOD_RES (20)..(20): C-terminal amidation
FCSKGNVFVDGYFERLRAKL

SEQ ID NO: 630 - protein, 20 aa, Artificial Sequence
  Synthetic peptide
  MOD_RES (1)..(1): N-terminal acetylation
  MOD_RES (20)..(20): C-terminal amidation
FQSCGNVFVDGYFERLRAKL

SEQ ID NO: 631 - protein, 20 aa, Artificial Sequence
  Synthetic peptide
  MOD_RES (1)..(1): N-terminal acetylation
  MOD_RES (20)..(20): C-terminal amidation
FQSKGNCFVDGYFERLRAKL

SEQ ID NO: 632 - protein, 20 aa, Artificial Sequence
  Synthetic peptide
  MOD_RES (1)..(1): N-terminal acetylation
  MOD_RES (20)..(20): C-terminal amidation
FQSKGNVFVCGYFERLRAKL

SEQ ID NO: 633 - protein, 20 aa, Artificial Sequence
  Synthetic peptide
  MOD_RES (1)..(1): N-terminal acetylation
  MOD_RES (20)..(20): C-terminal amidation
FQSKGNVFVDCYFERLRAKL

SEQ ID NO: 634 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERCRAKL

SEQ ID NO: 635 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKC

SEQ ID NO: 636 - protein, 20 aa, Artificial Sequence
  Synthetic peptide
  MOD_RES (1)..(1): N-terminal acetylation
  MOD_RES (20)..(20): C-terminal amidation
FQSFKNVFVDGYFERLCAKL

SEQ ID NO: 637 - protein, 20 aa, Artificial Sequence
  Synthetic peptide
  MOD_RES (1)..(1): N-terminal acetylation
  MOD_RES (20)..(20): C-terminal amidation
FQSKVNVFVDGYFERLCAKL

SEQ ID NO: 638 - protein, 20 aa, Artificial Sequence
  Synthetic peptide
  MOD_RES (1)..(1): N-terminal acetylation
  MOD_RES (20)..(20): C-terminal amidation
FQSIKNVFVDGYFERLCAKL

SEQ ID NO: 639 - protein, 20 aa, Artificial Sequence
  Synthetic peptide
  MOD_RES (1)..(1): N-terminal acetylation
  MOD_RES (20)..(20): C-terminal amidation
FQSKERVFVDGYFERLCAKL

SEQ ID NO: 640 - protein, 20 aa, Artificial Sequence
  Synthetic peptide
  MOD_RES (1)..(1): N-terminal acetylation
  MOD_RES (20)..(20): C-terminal amidation
FQSKENVFVDGYFDRLCAKL

SEQ ID NO: 641 - protein, 20 aa, Artificial Sequence
  Synthetic peptide
  MOD_RES (1)..(1): N-terminal acetylation
  MOD_RES (20)..(20): C-terminal amidation
FQSKQNVFVDGYFERLCIKL

SEQ ID NO: 642 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLCVKL

SEQ ID NO: 643 - protein, 20 aa, Artificial Sequence
  Synthetic peptide
  MOD_RES (1)..(1): N-terminal acetylation
  MOD_RES (20)..(20): C-terminal amidation
FQSYKNVFVDGYFERLCAKL

SEQ ID NO: 644 - protein, 20 aa, Artificial Sequence
  Synthetic peptide
  MOD_RES (1)..(1): N-terminal acetylation
  MOD_RES (20)..(20): C-terminal amidation
FQSKHNVFVDGYFERLCFKL

SEQ ID NO: 645 - protein, 20 aa, Artificial Sequence
  Synthetic peptide
  MOD_RES (1)..(1): N-terminal acetylation
  MOD_RES (20)..(20): C-terminal amidation
FQSKYNVFVDGYFERLCAKL

SEQ ID NO: 646 - protein, 20 aa, Artificial Sequence
  Synthetic peptide
  MOD_RES (1)..(1): N-terminal acetylation
  MOD_RES (20)..(20): C-terminal amidation
FQSFKHVFVDGYFERLCAKL

SEQ ID NO: 647 - protein, 20 aa, Artificial Sequence
  Synthetic peptide
  MOD_RES (1)..(1): N-terminal acetylation
  MOD_RES (20)..(20): C-terminal amidation
LQSKTNVFVDGYFERLCAKL

SEQ ID NO: 648 - protein, 20 aa, Artificial Sequence
  Synthetic peptide
  MOD_RES (1)..(1): N-terminal acetylation
  MOD_RES (20)..(20): C-terminal amidation
FQSKCNVFVDGYFERLCAKL

SEQ ID NO: 649 - protein, 20 aa, Artificial Sequence
  Synthetic peptide
  MOD_RES (1)..(1): N-terminal acetylation
  MOD_RES (20)..(20): C-terminal amidation
FQSKFNVFVDGYTERLCAKL

SEQ ID NO: 650 - protein, 20 aa, Artificial Sequence
  Synthetic peptide
  MOD_RES (1)..(1): N-terminal acetylation
  MOD_RES (20)..(20): C-terminal amidation
FQSVKNVFVDGYFERLCAKL

SEQ ID NO: 651 - protein, 20 aa, Artificial Sequence
  Synthetic peptide
  MOD_RES (1)..(1): N-terminal acetylation
  MOD_RES (20)..(20): C-terminal amidation
FQSKGNWFVDGYFERLCAKL

SEQ ID NO: 652 - protein, 20 aa, Artificial Sequence
  Synthetic peptide
  MOD_RES (1)..(1): N-terminal acetylation
  MOD_RES (20)..(20): C-terminal amidation
FQSKVAVFVDGYFERLCAKL

SEQ ID NO: 653 - protein, 20 aa, Artificial Sequence
  Synthetic peptide
  MOD_RES (1)..(1): N-terminal acetylation
  MOD_RES (20)..(20): C-terminal amidation
FQSCKNVFVDGYFVRLRAKL

SEQ ID NO: 654 - protein, 20 aa, Artificial Sequence
  Synthetic peptide
  MOD_RES (1)..(1): N-terminal acetylation
  MOD_RES (20)..(20): C-terminal amidation
FQSKTNVFVDGYFERLCAKL

SEQ ID NO: 655 - protein, 20 aa, Artificial Sequence
  Synthetic peptide
  MOD_RES (1)..(1): N-terminal acetylation
  MOD_RES (20)..(20): C-terminal amidation
FQSKKDVFVDGYFERLCAKL

SEQ ID NO: 656 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLCARL

SEQ ID NO: 657 - protein, 20 aa, Artificial Sequence
  Synthetic peptide
  MOD_RES (1)..(1): N-terminal acetylation
  MOD_RES (20)..(20): C-terminal amidation
FQSDKNVFVDGYFERLCAKL

SEQ ID NO: 658 - protein, 20 aa, Artificial Sequence
  Synthetic peptide
  MOD_RES (1)..(1): N-terminal acetylation
  MOD_RES (20)..(20): C-terminal amidation
FQSHKNVFVEGYFERLCAKL

SEQ ID NO: 659 - protein, 20 aa, Artificial Sequence
  Synthetic peptide
  MOD_RES (1)..(1): N-terminal acetylation
  MOD_RES (20)..(20): C-terminal amidation
FQSKPNVFVDGYFERLCAKL

SEQ ID NO: 660 - protein, 20 aa, Artificial Sequence
  Synthetic peptide
  MOD_RES (1)..(1): N-terminal acetylation
  MOD_RES (20)..(20): C-terminal amidation
FQSYKDVFVDGYFERLCTKL

SEQ ID NO: 661 - protein, 20 aa, Artificial Sequence
  Synthetic peptide
  MOD_RES (1)..(1): N-terminal acetylation
  MOD_RES (20)..(20): C-terminal amidation
FQSKLNVFVDGYFERLCAKL

SEQ ID NO: 662 - protein, 20 aa, Artificial Sequence
  Synthetic peptide
  MOD_RES (1)..(1): N-terminal acetylation
  MOD_RES (20)..(20): C-terminal amidation
FQSKNNFFVDGYFERLCARL

SEQ ID NO: 663 - protein, 20 aa, Artificial Sequence
  Synthetic peptide
  MOD_RES (1)..(1): N-terminal acetylation
  MOD_RES (20)..(20): C-terminal amidation
FQSKYNIFVDGYFERLCAKL

SEQ ID NO: 664 - protein, 20 aa, Artificial Sequence
  Synthetic peptide
  MOD_RES (1)..(1): N-terminal acetylation
  MOD_RES (20)..(20): C-terminal amidation
HQQFKNVFVDGYFERLCAKL

SEQ ID NO: 665 - protein, 20 aa, Artificial Sequence
  Synthetic peptide
  MOD_RES (1)..(1): N-terminal acetylation
  MOD_RES (3)..(3): Xaa is 2-Amino-isobutyric acid
  MOD_RES (17)..(17): Xaa is 2-Amino-isobutyric acid
  MOD_RES (20)..(20): C-terminal amidation
FQXKGNVFVDGYFERLXAKL

SEQ ID NO: 666 - protein, 20 aa, Artificial Sequence
  Synthetic peptide
  MOD_RES (1)..(1): N-terminal acetylation
  MOD_RES (6)..(6): Xaa is 2-Amino-isobutyric acid
  MOD_RES (17)..(17): Xaa is 2-Amino-isobutyric acid
  MOD_RES (20)..(20): C-terminal amidation
FQSKGXVFVDGYFERLXAKL

SEQ ID NO: 667 - protein, 20 aa, Artificial Sequence
  Synthetic peptide
  MOD_RES (1)..(1): N-terminal acetylation
  MOD_RES (9)..(9): Xaa is 2-Amino-isobutyric acid
  MOD_RES (17)..(17): Xaa is 2-Amino-isobutyric acid
  MOD_RES (20)..(20): C-terminal amidation
FQSKGNVFXDGYFERLXAKL

SEQ ID NO: 668 - protein, 20 aa, Artificial Sequence
  Synthetic peptide
  MOD_RES (1)..(1): N-terminal acetylation
  misc_feature (10)..(10): Xaa can be any naturally occurring amino acid
  MOD_RES (11)..(11): Xaa is 2-Amino-isobutyric acid
  MOD_RES (17)..(17): Xaa is 2-Amino-isobutyric acid
  MOD_RES (20)..(20): C-terminal amidation
FQSKGNVFVXGYFERLXAKL

SEQ ID NO: 669 - protein, 20 aa, Artificial Sequence
  Synthetic peptide
  MOD_RES (1)..(1): N-terminal acetylation
  MOD_RES (11)..(11): Xaa is 2-Amino-isobutyric acid
  MOD_RES (17)..(17): Xaa is 2-Amino-isobutyric acid
  MOD_RES (20)..(20): C-terminal amidation
FQSKGNVFVDXYFERLXAKL

SEQ ID NO: 670 - protein, 20 aa, Artificial Sequence
  Synthetic peptide
  MOD_RES (1)..(1): N-terminal acetylation
  DISULFID (5)..(17): Cys residues linked via disulfide bond
  MOD_RES (20)..(20): C-terminal amidation
FQSKCNVFVDGYFERLCAKL

SEQ ID NO: 671 - protein, 20 aa, Artificial Sequence
  Synthetic peptide
  MOD_RES (1)..(1): N-terminal acetylation
  DISULFID (10)..(17): Cys residues linked via disulfide bond
  MOD_RES (20)..(20): C-terminal amidation
FQSKGNVFVCGYFERLCAKL

SEQ ID NO: 672 - protein, 20 aa, Artificial Sequence
  Synthetic peptide
  MOD_RES (1)..(1): N-terminal acetylation
  MOD_RES (20)..(20): C-terminal amidation
FQSKKNNFVFGYFERLRAKL

SEQ ID NO: 673 - protein, 20 aa, Artificial Sequence
  Synthetic peptide
  MOD_RES (1)..(1): N-terminal acetylation
  MOD_RES (20)..(20): C-terminal amidation
FQSKKNVVVFGYFERLRAKL

SEQ ID NO: 674 - protein, 20 aa, Artificial Sequence
  Synthetic peptide
  MOD_RES (1)..(1): N-terminal acetylation
  MOD_RES (20)..(20): C-terminal amidation
FQSKKNVFQFGYFERLRAKL

SEQ ID NO: 675 - protein, 20 aa, Artificial Sequence
  Synthetic peptide
  MOD_RES (1)..(1): N-terminal acetylation
  MOD_RES (3)..(3): (S)-N-methyl-Ser
  MOD_RES (20)..(20): C-terminal amidation
FQSKGNVFVFGYFERLRAKL

SEQ ID NO: 676 - protein, 20 aa, Artificial Sequence
  Synthetic peptide
  MOD_RES (1)..(1): N-terminal acetylation
  MOD_RES (9)..(9): (S)-N-methyl-Val
  MOD_RES (20)..(20): C-terminal amidation
FQSKGNVFVFGYFERLRAKL

SEQ ID NO: 677 - protein, 20 aa, Artificial Sequence
  Synthetic peptide
  MOD_RES (1)..(1): N-terminal acetylation
  MOD_RES (13)..(13): (S)-N-methyl-Phe
  MOD_RES (20)..(20): C-terminal amidation
FQSKGNVFVFGYFERLRAKL

SEQ ID NO: 678 - protein, 20 aa, Artificial Sequence
  Synthetic peptide
  MOD_RES (1)..(1): N-terminal acetylation
  MOD_RES (14)..(14): (S)-N-methyl-Glu
  MOD_RES (20)..(20): C-terminal amidation
FQSKGNVFVFGYFERLRAKL

SEQ ID NO: 679 - protein, 20 aa, Artificial Sequence
  Synthetic peptide
  MOD_RES (1)..(1): N-terminal acetylation
  MOD_RES (18)..(18): (S)-N-methyl-Ala
  MOD_RES (20)..(20): C-terminal amidation
FQSKGNVFVFGYFERLRAKL

SEQ ID NO: 680 - protein, 20 aa, Artificial Sequence
  Synthetic peptide
  MOD_RES (1)..(1): N-terminal acetylation
  MOD_RES (2)..(2): beta-Homoglutamine
  MOD_RES (20)..(20): C-terminal amidation
FESKGNVFVFGYFERLRAKL

SEQ ID NO: 681 - protein, 20 aa, Artificial Sequence
  Synthetic peptide
  MOD_RES (1)..(1): N-terminal acetylation
  MOD_RES (8)..(8): beta-Homophenylalanine
  MOD_RES (20)..(20): C-terminal amidation
FQSKGNVFVFGYFERLRAKL

SEQ ID NO: 682 - protein, 20 aa, Artificial Sequence
  Synthetic peptide
  MOD_RES (1)..(1): N-terminal acetylation
  MOD_RES (10)..(10): beta-Homophenylalanine
  MOD_RES (20)..(20): C-terminal amidation
FQSKGNVFVFGYFERLRAKL

SEQ ID NO: 683 - protein, 20 aa, Artificial Sequence
  Synthetic peptide
  MOD_RES (1)..(1): N-terminal acetylation
  MOD_RES (13)..(13): beta-Homophenylalanine
  MOD_RES (20)..(20): C-terminal amidation
FQSKGNVFVFGYFERLRAKL

SEQ ID NO: 684 - protein, 20 aa, Artificial Sequence
  Synthetic peptide
  MOD_RES (1)..(1): N-terminal acetylation
  MOD_RES (16)..(16): beta-Homoleucine
  MOD_RES (20)..(20): C-terminal amidation
FQSKGNVFVFGYFERLRAKL

SEQ ID NO: 685 - protein, 20 aa, Artificial Sequence
  Synthetic peptide
  MOD_RES (1)..(1): N-terminal acetylation
  MOD_RES (15)..(15): Xaa is (S)-Citrullin
  MOD_RES (20)..(20): C-terminal amidation
FQSKGNVFVFGYFEXLRAKL

SEQ ID NO: 686 - protein, 20 aa, Artificial Sequence
  Synthetic peptide
  MOD_RES (1)..(1): N-terminal acetylation
  MOD_RES (20)..(20): C-terminal amidation
FQSKKNVGVFGYFERLRAKL

SEQ ID NO: 687 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERGRAKL

SEQ ID NO: 688 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAGL

SEQ ID NO: 689 - protein, 20 aa, Artificial Sequence
  Synthetic peptide
  MOD_RES (1)..(1): N-terminal acetylation
  MOD_RES (20)..(20): C-terminal amidation
FQSKKNVFVFGKFERLRAKL

SEQ ID NO: 690 - protein, 20 aa, Artificial Sequence
  Synthetic peptide
  MOD_RES (1)..(1): N-terminal acetylation
  MOD_RES (20)..(20): C-terminal amidation
FQSKFNVFVFGYFERLRAKL

SEQ ID NO: 691 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRFKL

SEQ ID NO: 692 - protein, 20 aa, Artificial Sequence
  Synthetic peptide
  MOD_RES (1)..(1): N-terminal acetylation
  MOD_RES (20)..(20): C-terminal amidation
LQSKKNVFVFGYFERLRAKL

SEQ ID NO: 693 - protein, 20 aa, Artificial Sequence
  Synthetic peptide
  MOD_RES (1)..(1): N-terminal acetylation
  MOD_RES (20)..(20): C-terminal amidation
FQSKKNVFVFGYLERLRAKL

SEQ ID NO: 694 - protein, 20 aa, Artificial Sequence
  Synthetic peptide
  MOD_RES (1)..(1): N-terminal acetylation
  MOD_RES (20)..(20): C-terminal amidation
FQSKGNVFLFGYFERLRAKL

SEQ ID NO: 695 - protein, 20 aa, Artificial Sequence
  Synthetic peptide
  MOD_RES (1)..(1): N-terminal acetylation
  MOD_RES (20)..(20): C-terminal amidation
FASKKNVFVFGYFERLRAKL

SEQ ID NO: 696 - protein, 20 aa, Artificial Sequence
  Synthetic peptide
  MOD_RES (1)..(1): N-terminal acetylation
  MOD_RES (20)..(20): C-terminal amidation
FQSKKPVFVFGYFERLRAKL

SEQ ID NO: 697 - protein, 20 aa, Artificial Sequence
  Synthetic peptide
  MOD_RES (1)..(1): N-terminal acetylation
  MOD_RES (20)..(20): C-terminal amidation
FQSKKNVFVFSYFERLRAKL

SEQ ID NO: 698 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRLKL

SEQ ID NO: 699 - protein, 20 aa, Artificial Sequence
  Synthetic peptide
  MOD_RES (1)..(1): N-terminal acetylation
  MOD_RES (3)..(3): D-Ser
  MOD_RES (20)..(20): N-terminal acetylation
FQSKKNVFVFGYFERLRAKL

SEQ ID NO: 700 - protein, 20 aa, Artificial Sequence
  Synthetic peptide
  MOD_RES (1)..(1): N-terminal acetylation
  MOD_RES (13)..(13): D-Phe
  MOD_RES (20)..(20): C-terminal amidation
FQSKKNVFVFGYFERLRAKL

SEQ ID NO: 701 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRGKL

SEQ ID NO: 702 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRKKL

SEQ ID NO: 703 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKK

SEQ ID NO: 704 - protein, 20 aa, Artificial Sequence
  Synthetic peptide
  MOD_RES (1)..(1): N-terminal acetylation
  MOD_RES (17)..(17): Xaa is Norleucine
  MOD_RES (20)..(20): C-terminal amidation
FQSKANVFVTGYFERLXAKL

SEQ ID NO: 705 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLGAKL

SEQ ID NO: 706 - protein, 20 aa, Artificial Sequence
  Synthetic peptide
  MOD_RES (1)..(1): N-terminal acetylation
  MOD_RES (20)..(20): C-terminal amidation
FQSVKNVFVDGYFERLAAKL

SEQ ID NO: 707 - protein, 20 aa, Artificial Sequence
  Synthetic peptide
  MOD_RES (1)..(1): N-terminal acetylation
  MOD_RES (20)..(20): C-terminal amidation
FQSKVAVFVDGYFERLAAKL

SEQ ID NO: 708 - protein, 20 aa, Artificial Sequence
  Synthetic peptide
  MOD_RES (1)..(1): N-terminal acetylation
  MOD_RES (20)..(20): C-terminal amidation
FQSKENVFVDGYFERLCYKL

SEQ ID NO: 709 - protein, 20 aa, Artificial Sequence
  Synthetic peptide
  MOD_RES (1)..(1): N-terminal acetylation
  MOD_RES (20)..(20): C-terminal amidation
FQSTKNVFVDGYFERLCAKL

SEQ ID NO: 710 - protein, 20 aa, Artificial Sequence
  Synthetic peptide
  MOD_RES (1)..(1): N-terminal acetylation
  MOD_RES (2)..(2): Xaa is 2-Amino-isobutyric acid
  MOD_RES (17)..(17): Xaa is 2-Amino-isobutyric acid
  MOD_RES (20)..(20): C-terminal amidation
FXSKGNVFVDGYFERLXAKL

SEQ ID NO: 711 - protein, 20 aa, Artificial Sequence
  Synthetic peptide
  MOD_RES (1)..(1): N-terminal acetylation
  MOD_RES (7)..(7): Xaa is 2-Amino-isobutyric acid
  MOD_RES (17)..(17): Xaa is 2-Amino-isobutyric acid
  MOD_RES (20)..(20): C-terminal amidation
FQSKGNXFVDGYFERLXAKL

SEQ ID NO: 712 - protein, 23 aa, Artificial Sequence
  Synthetic peptide
  MOD_RES (1)..(1): N-terminal acetylation
  MOD_RES (23)..(23): C-terminal amidation
KKKKNVFVFGYFERLRAKLTSKK

SEQ ID NO: 713 - protein, 20 aa, Artificial Sequence
  Synthetic peptide
  MOD_RES (1)..(1): N-terminal acetylation
  MOD_RES (20)..(20): C-terminal amidation
FSSKKNVFVFGYFERLRAKL

SEQ ID NO: 714 - protein, 20 aa, Artificial Sequence
  Synthetic peptide
  MOD_RES (1)..(1): N-terminal acetylation
  MOD_RES (12)..(12): (S)-N-methyl-Tyr
  MOD_RES (20)..(20): C-terminal amidation
FQSKGNVFVFGYFERLRAKL

SEQ ID NO: 715 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERKRAKL

SEQ ID NO: 716 - protein, 20 aa, Artificial Sequence
  Synthetic peptide
  MOD_RES (1)..(1): N-terminal acetylation
  MOD_RES (20)..(20): C-terminal amidation
FQSKKNVFVFDYFERLRAKL

SEQ ID NO: 717 - protein, 20 aa, Artificial Sequence
  Synthetic peptide
  MOD_RES (1)..(1): N-terminal acetylation
  MOD_RES (20)..(20): C-terminal amidation
FQSKKNVFVFGYDERLRAKL

SEQ ID NO: 718 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRADL

SEQ ID NO: 719 - protein, 20 aa, Artificial Sequence
  Synthetic peptide
  MOD_RES (1)..(1): N-terminal acetylation
  MOD_RES (20)..(20): C-terminal amidation
FQSKKNVLVFGYFERLRAKL

SEQ ID NO: 720 - protein, 20 aa, Artificial Sequence
  Synthetic peptide
FQSKGNVFVFGYFERLRAKL

SEQ ID NO: 721 - protein, 20 aa, Artificial Sequence
  Synthetic peptide
  MOD_RES (1)..(1): N-terminal acetylation
  MOD_RES (20)..(20): C-terminal amidation
AQSKKNVFVFGYFERLRAKL

SEQ ID NO: 722 - protein, 20 aa, Artificial Sequence
  Synthetic peptide
  MOD_RES (1)..(1): N-terminal acetylation
  MOD_RES (20)..(20): C-terminal amidation
FQSKPNVFVFGYFERLRAKL

SEQ ID NO: 723 - protein, 20 aa, Artificial Sequence
  Synthetic peptide
  MOD_RES (1)..(1): N-terminal acetylation
  MOD_RES (20)..(20): C-terminal amidation
FQSKKNVFPFGYFERLRAKL

SEQ ID NO: 724 - protein, 20 aa, Artificial Sequence
  Synthetic peptide
  MOD_RES (1)..(1): N-terminal acetylation
  MOD_RES (20)..(20): C-terminal amidation
FQSKKNSFVFGYFERLRAKL

SEQ ID NO: 725 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLLAKL

SEQ ID NO: 726 - protein, 20 aa, Artificial Sequence
  Synthetic peptide
  MOD_RES (1)..(1): N-terminal acetylation
  MOD_RES (1)..(1): D-Phe
  MOD_RES (20)..(20): C-terminal amidation
FQSKKNVFVFGYFERLRAKL

SEQ ID NO: 727 - protein, 20 aa, Artificial Sequence
  Synthetic peptide
  MOD_RES (1)..(1): N-terminal acetylation
  MOD_RES (2)..(2): D-Gln
  MOD_RES (20)..(20): C-terminal amidation
FQSKKNVFVFGYFERLRAKL

SEQ ID NO: 728 - protein, 20 aa, Artificial Sequence
  Synthetic peptide
  MOD_RES (1)..(1): N-terminal acetylation
  MOD_RES (6)..(6): D-Asn
  MOD_RES (20)..(20): C-terminal amidation
FQSKKNVFVFGYFERLRAKL

SEQ ID NO: 729 - protein, 20 aa, Artificial Sequence
  Synthetic peptide
  MOD_RES (1)..(1): N-terminal acetylation
  MOD_RES (7)..(7): D-Val
  MOD_RES (20)..(20): C-terminal amidation
FQSKKNVFVFGYFERLRAKL

SEQ ID NO: 730 - protein, 20 aa, Artificial Sequence
  Synthetic peptide
  MOD_RES (1)..(1): N-terminal acetylation
  MOD_RES (8)..(8): D-Phe
  MOD_RES (20)..(20): C-terminal amidation
FQSKKNVFVFGYFERLRAKL

SEQ ID NO: 731 - protein, 20 aa, Artificial Sequence
  Synthetic peptide
  MOD_RES (1)..(1): N-terminal acetylation
  MOD_RES (20)..(20): C-terminal amidation
FQSKGNVFADGYFERLRAKL

SEQ ID NO: 732 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKA

SEQ ID NO: 733 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKN

SEQ ID NO: 734 - protein, 20 aa, Artificial Sequence
  Synthetic peptide
  MOD_RES (1)..(1): N-terminal acetylation
  MOD_RES (20)..(20): C-terminal amidation
SQSKGNVFVDGYFERLRAKL

SEQ ID NO: 735 - protein, 20 aa, Artificial Sequence
  Synthetic peptide
  MOD_RES (1)..(1): N-terminal acetylation
  MOD_RES (20)..(20): C-terminal amidation
FQSKKNVFFFGYFERLRAKL

SEQ ID NO: 736 - protein, 20 aa, Artificial Sequence
  Synthetic peptide
  MOD_RES (1)..(1): N-terminal acetylation
  MOD_RES (20)..(20): C-terminal amidation
FQSKKDVFVDGYFERLAAKL

SEQ ID NO: 737 - protein, 20 aa, Artificial Sequence
  Synthetic peptide
  MOD_RES (1)..(1): N-terminal acetylation
  MOD_RES (20)..(20): C-terminal amidation
FQSKSNVFVDGYFERLAARL

SEQ ID NO: 738 - protein, 20 aa, Artificial Sequence
  Synthetic peptide
  MOD_RES (1)..(1): N-terminal acetylation
  MOD_RES (20)..(20): C-terminal amidation
FQSTKNVFVDGYFERLAAKL

SEQ ID NO: 739 - protein, 20 aa, Artificial Sequence
  Synthetic peptide
  MOD_RES (1)..(1): N-terminal acetylation
  MOD_RES (20)..(20): C-terminal amidation
YQSKQNVFVDGYFERLAAKL

SEQ ID NO: 740 - protein, 20 aa, Artificial Sequence
  Synthetic peptide
  MOD_RES (1)..(1): N-terminal acetylation
  MOD_RES (20)..(20): C-terminal amidation
FQSFENVFVDGYFERLHAKL

SEQ ID NO: 741 - protein, 20 aa, Artificial Sequence
  Synthetic peptide
  MOD_RES (1)..(1): N-terminal acetylation
  MOD_RES (1)..(1): Xaa is 2-Amino-isobutyric acid
  MOD_RES (17)..(17): Xaa is 2-Amino-isobutyric acid
  MOD_RES (20)..(20): C-terminal amidation
XQSKGNVFVDGYFERLXAKL

SEQ ID NO: 742 - protein, 30 aa, Artificial Sequence
  Synthetic peptide
  MOD_RES (1)..(1): N-terminal acetylation
  MOD_RES (30)..(30): C-terminal amidation
VVEKLTFVQLSFLNRRRFSQYAGFKGAGKV

SEQ ID NO: 743 - protein, 30 aa, Artificial Sequence
  Synthetic peptide
  MOD_RES (1)..(1): N-terminal acetylation
  MOD_RES (30)..(30): C-terminal amidation
RVFLYFSGKAGGLVKLVERQAFQTNVSKFR

SEQ ID NO: 744 - protein, 29 aa, Artificial Sequence
  Synthetic peptide
  MOD_RES (1)..(1): N-terminal acetylation
  MOD_RES (29)..(29): C-terminal amidation
KKSGVGRLQVAFQSKKNVFVFGYFERLKK

SEQ ID NO: 745 - protein, 26 aa, Artificial Sequence
  Synthetic peptide
  MOD_RES (1)..(1): N-terminal acetylation
  MOD_RES (26)..(26): C-terminal amidation
KKSGVGRLQVAFQSKKNVFVFGYFKK

SEQ ID NO: 746 - protein, 23 aa, Artificial Sequence
  Synthetic peptide
  MOD_RES (1)..(1): N-terminal acetylation
  MOD_RES (23)..(23): C-terminal amidation
KKSGVGRLQVAFQSKKNVFVFKK

SEQ ID NO: 747 - protein, 20 aa, Artificial Sequence
  Synthetic peptide
  MOD_RES (1)..(1): N-terminal acetylation
  MOD_RES (20)..(20): C-terminal amidation
FQSKQNVFVFGYFERLRAKL

SEQ ID NO: 748 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKN

SEQ ID NO: 749 - protein, 19 aa, Artificial Sequence
  Synthetic peptide
  MOD_RES (1)..(1): N-terminal acetylation
  MOD_RES (19)..(19): C-terminal amidation
FQSKKNVFVFGYFERLRAK

SEQ ID NO: 750 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFELLRAKL

SEQ ID NO: 751 - protein, 20 aa, Artificial Sequence
  Synthetic peptide
  MOD_RES (1)..(1): N-terminal acetylation
  MOD_RES (8)..(8): (S)-methyl-Phe
  MOD_RES (20)..(20): C-terminal amidation
FQSKGNVFVFGYFERLRAKL

SEQ ID NO: 752 - protein, 20 aa, Artificial Sequence
  Synthetic peptide
  MOD_RES (1)..(1): N-terminal acetylation
  MOD_RES (15)..(15): (S)-methyl-Arg
  MOD_RES (20)..(20): C-terminal amidation
FQSKGNVFVFGYFERLRAKL

SEQ ID NO: 753 - protein, 20 aa, Artificial Sequence
  Synthetic peptide
  MOD_RES (1)..(1): N-terminal acetylation
  MOD_RES (16)..(16): (S)-N-methyl-Leu
  MOD_RES (20)..(20): C-terminal amidation
FQSKGNVFVFGYFERLRAKL

SEQ ID NO: 754 - protein, 20 aa, Artificial Sequence
  Synthetic peptide
  MOD_RES (1)..(1): N-terminal acetylation
  MOD_RES (17)..(17): (S)-N-methyl-Arg
  MOD_RES (20)..(20): C-terminal amidation
FQSKGNVFVFGYFERLRAKL

SEQ ID NO: 755 - protein, 20 aa, Artificial Sequence
  Synthetic peptide
  MOD_RES (1)..(1): N-terminal acetylation
  MOD_RES (19)..(19): (S)-N-methyl-Lys
  MOD_RES (20)..(20): C-terminal amidation
FQSKGNVFVFGYFERLRAKL

SEQ ID NO: 756 - protein, 20 aa, Artificial Sequence
  Synthetic peptide
  MOD_RES (1)..(1): N-terminal acetylation
  MOD_RES (7)..(7): beta-Leu
  MOD_RES (20)..(20): C-terminal amidation
FQSKGNLFVFGYFERLRAKL

SEQ ID NO: 757 - protein, 20 aa, Artificial Sequence
  Synthetic peptide
  MOD_RES (1)..(1): N-terminal acetylation
  MOD_RES (9)..(9): beta-Leu
  MOD_RES (20)..(20): C-terminal amidation
FQSKGNVFLFGYFERLRAKL

SEQ ID NO: 758 - protein, 20 aa, Artificial Sequence
  Synthetic peptide
  MOD_RES (1)..(1): N-terminal acetylation
  MOD_RES (11)..(11): beta-Ala
  MOD_RES (20)..(20): C-terminal amidation
FQSKGNVFVFAYFERLRAKL

SEQ ID NO: 759 - protein, 20 aa, Artificial Sequence
  Synthetic peptide
  MOD_RES (1)..(1): N-terminal acetylation
  MOD_RES (12)..(12): beta-Tyr
  MOD_RES (20)..(20): C-terminal amidation
FQSKGNVFVFGYFERLRAKL

SEQ ID NO: 760 - protein, 20 aa, Artificial Sequence
  Synthetic peptide
  MOD_RES (1)..(1): N-terminal acetylation
  MOD_RES (15)..(15): beta-Homoarginine
  MOD_RES (20)..(20): C-terminal amidation
FQSKGNVFVFGYFERLRAKL

SEQ ID NO: 761 - protein, 20 aa, Artificial Sequence
  Synthetic peptide
  MOD_RES (1)..(1): N-terminal acetylation
  MOD_RES (15)..(15): Xaa is Norleucine
  MOD_RES (20)..(20): C-terminal amidation
FQSKGNVFVFGYFEXLRAKL

SEQ ID NO: 762 - protein, 20 aa, Artificial Sequence
  Synthetic peptide
  MOD_RES (1)..(1): N-terminal acetylation
  MOD_RES (20)..(20): C-terminal amidation
FQSKKNVFGFGYFERLRAKL

SEQ ID NO: 763 - protein, 20 aa, Artificial Sequence
  Synthetic peptide
  MOD_RES (1)..(1): N-terminal acetylation
  MOD_RES (20)..(20): C-terminal amidation
FQSKKNVFVFGGFERLRAKL

SEQ ID NO: 764 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEGLRAKL

SEQ ID NO: 765 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKK

SEQ ID NO: 766 - protein, 20 aa, Artificial Sequence
  Synthetic peptide
  MOD_RES (1)..(1): N-terminal acetylation
  MOD_RES (20)..(20): C-terminal amidation
FFSKKNVFVFGYFERLRAKL

SEQ ID NO: 767 - protein, 20 aa, Artificial Sequence
  Synthetic peptide
  MOD_RES (1)..(1): N-terminal acetylation
  MOD_RES (20)..(20): C-terminal amidation
FQFKKNVFVFGYFERLRAKL

SEQ ID NO: 768 - protein, 20 aa, Artificial Sequence
  Synthetic peptide
  MOD_RES (1)..(1): N-terminal acetylation
  MOD_RES (20)..(20): C-terminal amidation
FQSFKNVFVFGYFERLRAKL

SEQ ID NO: 769 - protein, 20 aa, Artificial Sequence
  Synthetic peptide
  MOD_RES (1)..(1): N-terminal acetylation
  MOD_RES (20)..(20): C-terminal amidation
FQSKKFVFVFGYFERLRAKL

SEQ ID NO: 770 - protein, 20 aa, Artificial Sequence
  Synthetic peptide
  MOD_RES (1)..(1): N-terminal acetylation
  MOD_RES (20)..(20): C-terminal amidation
FQSKKNVFVFFYFERLRAKL

SEQ ID NO: 771 - protein, 20 aa, Artificial Sequence
  Synthetic peptide
  MOD_RES (1)..(1): N-terminal acetylation
  MOD_RES (20)..(20): C-terminal amidation
FQSKKNVFVFGFFERLRAKL

SEQ ID NO: 772 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEFLRAKL

SEQ ID NO: 773 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERFRAKL

SEQ ID NO: 774 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLFAKL

SEQ ID NO: 775 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAFL

SEQ ID NO: 776 - protein, 20 aa, Artificial Sequence
  Synthetic peptide
  MOD_RES (1)..(1): N-terminal acetylation
  MOD_RES (20)..(20): C-terminal amidation
FDSKKNVFVFGYFERLRAKL

SEQ ID NO: 777 - protein, 20 aa, Artificial Sequence
  Synthetic peptide
  MOD_RES (1)..(1): N-terminal acetylation
  MOD_RES (20)..(20): C-terminal amidation
FQSDKNVFVFGYFERLRAKL

SEQ ID NO: 778 - protein, 20 aa, Artificial Sequence
  Synthetic peptide
  MOD_RES (1)..(1): N-terminal acetylation
  MOD_RES (20)..(20): C-terminal amidation
FQSKKNDFVFGYFERLRAKL

SEQ ID NO: 779 - protein, 20 aa, Artificial Sequence
  Synthetic peptide
  MOD_RES (1)..(1): N-terminal acetylation
  MOD_RES (20)..(20): C-terminal amidation
FQSKKNVDVFGYFERLRAKL

SEQ ID NO: 780 - protein, 20 aa, Artificial Sequence
  Synthetic peptide
  MOD_RES (1)..(1): N-terminal acetylation
  MOD_RES (20)..(20): C-terminal amidation
FQSKKNVFDFGYFERLRAKL

SEQ ID NO: 781 - protein, 20 aa, Artificial Sequence
  Synthetic peptide
  MOD_RES (1)..(1): N-terminal acetylation
  MOD_RES (20)..(20): C-terminal amidation
FQSKKNVFVFGDFERLRAKL

SEQ ID NO: 782 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERDRAKL

SEQ ID NO: 783 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLDAKL

SEQ ID NO: 784 - protein, 20 aa, Artificial Sequence
  Synthetic peptide
  MOD_RES (1)..(1): N-terminal acetylation
  MOD_RES (20)..(20): C-terminal amidation
FLSKKNVFVFGYFERLRAKL

SEQ ID NO: 785 - protein, 20 aa, Artificial Sequence
  Synthetic peptide
  MOD_RES (1)..(1): N-terminal acetylation
  MOD_RES (20)..(20): C-terminal amidation
FQLKKNVFVFGYFERLRAKL

SEQ ID NO: 786 - protein, 20 aa, Artificial Sequence
  Synthetic peptide
  MOD_RES (1)..(1): N-terminal acetylation
  MOD_RES (20)..(20): C-terminal amidation
FQSLKNVFVFGYFERLRAKL

SEQ ID NO: 787 - protein, 20 aa, Artificial Sequence
  Synthetic peptide
  MOD_RES (1)..(1): N-terminal acetylation
  MOD_RES (20)..(20): C-terminal amidation
FQSKLNVFVFGYFERLRAKL

SEQ ID NO: 788 - protein, 20 aa, Artificial Sequence
  Synthetic peptide
  MOD_RES (1)..(1): N-terminal acetylation
  MOD_RES (20)..(20): C-terminal amidation
FQSKKLVFVFGYFERLRAKL

SEQ ID NO: 789 - protein, 20 aa, Artificial Sequence
  Synthetic peptide
  MOD_RES (1)..(1): N-terminal acetylation
  MOD_RES (20)..(20): C-terminal amidation
FQSKKNVFLFGYFERLRAKL

SEQ ID NO: 790 - protein, 20 aa, Artificial Sequence
  Synthetic peptide
  MOD_RES (1)..(1): N-terminal acetylation
  MOD_RES (20)..(20): C-terminal amidation
FQSKKNVFVFLYFERLRAKL

SEQ ID NO: 791 - protein, 20 aa, Artificial Sequence
  Synthetic peptide
  MOD_RES (1)..(1): N-terminal acetylation
  MOD_RES (20)..(20): C-terminal amidation
FQSKKNVFVFGLFERLRAKL

SEQ ID NO: 792 - protein, 20 aa, Artificial Sequence
  Synthetic peptide
  MOD_RES (1)..(1): N-terminal acetylation
  MOD_RES (20)..(20): C-terminal amidation
FQSKKNVAVFGYFERLRAKL

SEQ ID NO: 793 - protein, 20 aa, Artificial Sequence
  Synthetic peptide
  MOD_RES (1)..(1): N-terminal acetylation
  MOD_RES (20)..(20): C-terminal amidation
FQSKKNVFVFAYFERLRAKL

SEQ ID NO: 794 - protein, 20 aa, Artificial Sequence
  Synthetic peptide
  MOD_RES (1)..(1): N-terminal acetylation
  MOD_RES (20)..(20): C-terminal amidation
FQSKKNVFVFGAFERLRAKL

SEQ ID NO: 795 - protein, 20 aa, Artificial Sequence
  Synthetic peptide
  MOD_RES (1)..(1): N-terminal acetylation
  MOD_RES (20)..(20): C-terminal amidation
FQSKKNVFVFGYAERLRAKL

SEQ ID NO: 796 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEALRAKL

SEQ ID NO: 797 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERARAKL

SEQ ID NO: 798 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAAL

SEQ ID NO: 799 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKA

SEQ ID NO: 800 - protein, 20 aa, Artificial Sequence
  Synthetic peptide
  MOD_RES (1)..(1): N-terminal acetylation
  MOD_RES (20)..(20): C-terminal amidation
PQSKKNVFVFGYFERLRAKL

SEQ ID NO: 801 - protein, 20 aa, Artificial Sequence
  Synthetic peptide
  MOD_RES (1)..(1): N-terminal acetylation
  MOD_RES (20)..(20): C-terminal amidation
FPSKKNVFVFGYFERLRAKL

SEQ ID NO: 802 - protein, 20 aa, Artificial Sequence
  Synthetic peptide
  MOD_RES (1)..(1): N-terminal acetylation
  MOD_RES (20)..(20): C-terminal amidation
FQSKKNVPVFGYFERLRAKL

SEQ ID NO: 803 - protein, 20 aa, Artificial Sequence
  Synthetic peptide
  MOD_RES (1)..(1): N-terminal acetylation
  MOD_RES (20)..(20): C-terminal amidation
FQSKKNVFVFPYFERLRAKL

SEQ ID NO: 804 - protein, 20 aa, Artificial Sequence
  Synthetic peptide
  MOD_RES (1)..(1): N-terminal acetylation
  MOD_RES (20)..(20): C-terminal amidation
FQSKKNVFVFGPFERLRAKL

SEQ ID NO: 805 - protein, 20 aa, Artificial Sequence
  Synthetic peptide
  MOD_RES (1)..(1): N-terminal acetylation
  MOD_RES (20)..(20): C-terminal amidation
FQSKKNVFVFGYPERLRAKL

SEQ ID NO: 806 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFEPLRAKL

SEQ ID NO: 807 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLPAKL

SEQ ID NO: 808 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRPKL

SEQ ID NO: 809 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAPL

SEQ ID NO: 810 - protein, 20 aa, Artificial Sequence
  Synthetic peptide
  MOD_RES (1)..(1): N-terminal acetylation
  MOD_RES (20)..(20): C-terminal amidation
SQSKKNVFVFGYFERLRAKL

SEQ ID NO: 811 - protein, 20 aa, Artificial Sequence
  Synthetic peptide
  MOD_RES (1)..(1): N-terminal acetylation
  MOD_RES (20)..(20): C-terminal amidation
FQSKSNVFVFGYFERLRAKL

SEQ ID NO: 812 - protein, 20 aa, Artificial Sequence
  Synthetic peptide
  MOD_RES (1)..(1): N-terminal acetylation
  MOD_RES (20)..(20): C-terminal amidation
FQSKKNVSVFGYFERLRAKL

SEQ ID NO: 813 - protein, 20 aa, Artificial Sequence
  Synthetic peptide
  MOD_RES (1)..(1): N-terminal acetylation
  MOD_RES (20)..(20): C-terminal amidation
FQSKKNVFVFGSFERLRAKL

SEQ ID NO: 814 - protein, 20 aa, Artificial Sequence
  Synthetic peptide
  MOD_RES (1)..(1): N-terminal acetylation
  MOD_RES (20)..(20): C-terminal amidation
FQSKKNVFVFGYSERLRAKL

SEQ ID NO: 815 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFESLRAKL

SEQ ID NO: 816 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERSRAKL

SEQ ID NO: 817 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLSAKL

SEQ ID NO: 818 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKS

SEQ ID NO: 819 - protein, 20 aa, Artificial Sequence
  Synthetic peptide
  MOD_RES (1)..(1): N-terminal acetylation
  MOD_RES (16)..(16): D-Leu
  MOD_RES (20)..(20): C-terminal amidation
FQSKKNVFVFGYFERLRAKL

SEQ ID NO: 820 - protein, 20 aa, Artificial Sequence
  Synthetic peptide
  MOD_RES (1)..(1): N-terminal acetylation
  MOD_RES (18)..(18): D-Ala
  MOD_RES (20)..(20): C-terminal amidation
FQSKKNVFVFGYFERLRAKL

SEQ ID NO: 821 - protein, 20 aa, Artificial Sequence
  Synthetic peptide
  MOD_RES (1)..(1): N-terminal acetylation
  MOD_RES (19)..(19): D-Lys
  MOD_RES (20)..(20): C-terminal amidation
FQSKKNVFVFGYFERLRAKL

SEQ ID NO: 822 - protein, 20 aa, Artificial Sequence
  Synthetic peptide
  MOD_RES (1)..(1): N-terminal acetylation
  MOD_RES (20)..(20): D-Leu
  MOD_RES (20)..(20): C-terminal amidation
FQSKKNVFVFGYFERLRAKL

SEQ ID NO: 823 - protein, 20 aa, Artificial Sequence
  Synthetic peptide
  MOD_RES (1)..(1): N-terminal acetylation
  MOD_RES (15)..(15): omega-methyl-Arg
  MOD_RES (17)..(17): omega-methyl-Arg
  MOD_RES (20)..(20): C-terminal amidation
FQSKKNVFVFGYFERLRAKL

SEQ ID NO: 824 - protein, 20 aa, Artificial Sequence
  Synthetic peptide
  MOD_RES (1)..(1): N-terminal acetylation
  MOD_RES (20)..(20): C-terminal amidation
FQSKGNVAVDGYFERLRAKL

SEQ ID NO: 825 - protein, 20 aa, Artificial Sequence
  Synthetic peptide
  MOD_RES (1)..(1): N-terminal acetylation
  MOD_RES (20)..(20): C-terminal amidation
FQSKGNVFVDAYFERLRAKL

SEQ ID NO: 826 - protein, 20 aa, Artificial Sequence
  Synthetic peptide
  MOD_RES (1)..(1): N-terminal acetylation
  MOD_RES (20)..(20): C-terminal amidation
FQSKGNVFVDGAFERLRAKL

SEQ ID NO: 827 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERARAKL

SEQ ID NO: 828 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAAL

SEQ ID NO: 829 - protein, 20 aa, Artificial Sequence
  Synthetic peptide
  MOD_RES (1)..(1): N-terminal acetylation
  MOD_RES (20)..(20): C-terminal amidation
DQSKGNVFVDGYFERLRAKL

SEQ ID NO: 830 - protein, 20 aa, Artificial Sequence
  Synthetic peptide
  MOD_RES (1)..(1): N-terminal acetylation
  MOD_RES (20)..(20): C-terminal amidation
FDSKGNVFVDGYFERLRAKL

SEQ ID NO: 831 - protein, 20 aa, Artificial Sequence
  Synthetic peptide
  MOD_RES (1)..(1): N-terminal acetylation
  MOD_RES (20)..(20): C-terminal amidation
FQSKGNDFVDGYFERLRAKL

SEQ ID NO: 832 - protein, 20 aa, Artificial Sequence
  Synthetic peptide
  MOD_RES (1)..(1): N-terminal acetylation
  MOD_RES (20)..(20): C-terminal amidation
FQSKGNVDVDGYFERLRAKL

SEQ ID NO: 833 - protein, 20 aa, Artificial Sequence
  Synthetic peptide
  MOD_RES (1)..(1): N-terminal acetylation
  MOD_RES (20)..(20): C-terminal amidation
FQSKGNVFDDGYFERLRAKL

SEQ ID NO: 834 - protein, 20 aa, Artificial Sequence
  Synthetic peptide
  MOD_RES (1)..(1): N-terminal acetylation
  MOD_RES (20)..(20): C-terminal amidation
FQSKGNVFVDDYFERLRAKL

SEQ ID NO: 835 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEDLRAKL

SEQ ID NO: 836 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERDRAKL

SEQ ID NO: 837 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRADL

SEQ ID NO: 838 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKD

SEQ ID NO: 839 - protein, 20 aa, Artificial Sequence
  Synthetic peptide
  MOD_RES (1)..(1): N-terminal acetylation
  MOD_RES (20)..(20): C-terminal amidation
FESKGNVFVDGYFERLRAKL

SEQ ID NO: 840 - protein, 20 aa, Artificial Sequence
  Synthetic peptide
  MOD_RES (1)..(1): N-terminal acetylation
  MOD_RES (20)..(20): C-terminal amidation
FQSKGNVEVDGYFERLRAKL

SEQ ID NO: 841 - protein, 20 aa, Artificial Sequence
  Synthetic peptide
  MOD_RES (1)..(1): N-terminal acetylation
  MOD_RES (20)..(20): C-terminal amidation
FQSKGNVFEDGYFERLRAKL

SEQ ID NO: 842 - protein, 20 aa, Artificial Sequence
  Synthetic peptide
  MOD_RES (1)..(1): N-terminal acetylation
  MOD_RES (20)..(20): C-terminal amidation
FQSKGNVFVDEYFERLRAKL

SEQ ID NO: 843 - protein, 20 aa, Artificial Sequence
  Synthetic peptide
  MOD_RES (1)..(1): N-terminal acetylation
  MOD_RES (20)..(20): C-terminal amidation
FQSKGNVFVDGEFERLRAKL

SEQ ID NO: 844 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERERAKL

SEQ ID NO: 845 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAEL

SEQ ID NO: 846 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKE

SEQ ID NO: 847 - protein, 20 aa, Artificial Sequence
  Synthetic peptide
  MOD_RES (1)..(1): N-terminal acetylation
  MOD_RES (20)..(20): C-terminal amidation
FQSKGNVFVDFYFERLRAKL

SEQ ID NO: 848 - protein, 20 aa, Artificial Sequence
  Synthetic peptide
  MOD_RES (1)..(1): N-terminal acetylation
  MOD_RES (20)..(20): C-terminal amidation
FQSKGNVFVDGFFERLRAKL

SEQ ID NO: 849 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERFRAKL

SEQ ID NO: 850 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAFL

SEQ ID NO: 851 - protein, 20 aa, Artificial Sequence
  Synthetic peptide
  MOD_RES (1)..(1): N-terminal acetylation
  MOD_RES (20)..(20): C-terminal amidation
GQSKGNVFVDGYFERLRAKL

SEQ ID NO: 852 - protein, 20 aa, Artificial Sequence
  Synthetic peptide
  MOD_RES (1)..(1): N-terminal acetylation
  MOD_RES (20)..(20): C-terminal amidation
FQSKGNGFVDGYFERLRAKL

SEQ ID NO: 853 - protein, 20 aa, Artificial Sequence
  Synthetic peptide
  MOD_RES (1)..(1): N-terminal acetylation
  MOD_RES (20)..(20): C-terminal amidation
FQSKGNVGVDGYFERLRAKL

SEQ ID NO: 854 - protein, 20 aa, Artificial Sequence
  Synthetic peptide
  MOD_RES (1)..(1): N-terminal acetylation
  MOD_RES (20)..(20): C-terminal amidation
FQSKGNVFGDGYFERLRAKL

SEQ ID NO: 855 - protein, 20 aa, Artificial Sequence
  Synthetic peptide
  MOD_RES (1)..(1): N-terminal acetylation
  MOD_RES (20)..(20): C-terminal amidation
FQSKGNVFVDGGFERLRAKL

SEQ ID NO: 856 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERGRAKL

SEQ ID NO: 857 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAGL

SEQ ID NO: 858 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKG

SEQ ID NO: 859 - protein, 20 aa, Artificial Sequence
  Synthetic peptide
  MOD_RES (1)..(1): N-terminal acetylation
  MOD_RES (20)..(20): C-terminal amidation
FHSKGNVFVDGYFERLRAKL

SEQ ID NO: 860 - protein, 20 aa, Artificial Sequence
  Synthetic peptide
  MOD_RES (1)..(1): N-terminal acetylation
  MOD_RES (20)..(20): C-terminal amidation
FQSKGNVFHDGYFERLRAKL

SEQ ID NO: 861 - protein, 20 aa, Artificial Sequence
  Synthetic peptide
  MOD_RES (1)..(1): N-terminal acetylation
  MOD_RES (20)..(20): C-terminal amidation
FQSKGNVFVDGHFERLRAKL

SEQ ID NO: 862 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEHLRAKL

SEQ ID NO: 863 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERHRAKL

SEQ ID NO: 864 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAHL

SEQ ID NO: 865 - protein, 20 aa, Artificial Sequence
  Synthetic peptide
  MOD_RES (1)..(1): N-terminal acetylation
  MOD_RES (20)..(20): C-terminal amidation
FQSKGNVIVDGYFERLRAKL

SEQ ID NO: 866 - protein, 20 aa, Artificial Sequence
  Synthetic peptide
  MOD_RES (1)..(1): N-terminal acetylation
  MOD_RES (20)..(20): C-terminal amidation
FQSKGNVFVDIYFERLRAKL

SEQ ID NO: 867 - protein, 20 aa, Artificial Sequence
  Synthetic peptide
  MOD_RES (1)..(1): N-terminal acetylation
  MOD_RES (20)..(20): C-terminal amidation
FQSKGNVFVDGIFERLRAKL

SEQ ID NO: 868 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEILRAKL

SEQ ID NO: 869 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERIRAKL

SEQ ID NO: 870 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAIL

SEQ ID NO: 871 - protein, 20 aa, Artificial Sequence
  Synthetic peptide
  MOD_RES (1)..(1): N-terminal acetylation
  MOD_RES (20)..(20): C-terminal amidation
FKSKGNVFVDGYFERLRAKL

SEQ ID NO: 872 - protein, 20 aa, Artificial Sequence
  Synthetic peptide
  MOD_RES (1)..(1): N-terminal acetylation
  MOD_RES (20)..(20): C-terminal amidation
FQSKGNKFVDGYFERLRAKL

SEQ ID NO: 873 - protein, 20 aa, Artificial Sequence
  Synthetic peptide
  MOD_RES (1)..(1): N-terminal acetylation
  MOD_RES (20)..(20): C-terminal amidation
FQSKGNVKVDGYFERLRAKL

SEQ ID NO: 874 - protein, 20 aa, Artificial Sequence
  Synthetic peptide
  MOD_RES (1)..(1): N-terminal acetylation
  MOD_RES (20)..(20): C-terminal amidation
FQSKGNVFVDKYFERLRAKL

SEQ ID NO: 875 - protein, 20 aa, Artificial Sequence
  Synthetic peptide
  MOD_RES (1)..(1): N-terminal acetylation
  MOD_RES (20)..(20): C-terminal amidation
FQSKGNVFVDGKFERLRAKL

SEQ ID NO: 876 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEKLRAKL

SEQ ID NO: 877 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERKRAKL

SEQ ID NO: 878 - protein, 20 aa, Artificial Sequence
  Synthetic peptide
  MOD_RES (1)..(1): N-terminal acetylation
  MOD_RES (20)..(20): C-terminal amidation
FLSKGNVFVDGYFERLRAKL

SEQ ID NO: 879 - protein, 20 aa, Artificial Sequence
  Synthetic peptide
  MOD_RES (1)..(1): N-terminal acetylation
  MOD_RES (20)..(20): C-terminal amidation
FQSKGNVLVDGYFERLRAKL

SEQ ID NO: 880 - protein, 20 aa, Artificial Sequence
  Synthetic peptide
  MOD_RES (1)..(1): N-terminal acetylation
  MOD_RES (20)..(20): C-terminal amidation
FQSKGNVFLDGYFERLRAKL

SEQ ID NO: 881 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRALL

SEQ ID NO: 882 - protein, 20 aa, Artificial Sequence
  Synthetic peptide
  MOD_RES (1)..(1): N-terminal acetylation
  MOD_RES (20)..(20): C-terminal amidation
FQSKGNMFVDGYFERLRAKL

SEQ ID NO: 883 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERMRAKL

SEQ ID NO: 884 - protein, 20 aa, Artificial Sequence
  Synthetic peptide
  MOD_RES (1)..(1): N-terminal acetylation
  MOD_RES (20)..(20): C-terminal amidation
FQSKGNNFVDGYFERLRAKL

SEQ ID NO: 885 - protein, 20 aa, Artificial Sequence
  Synthetic peptide
  MOD_RES (1)..(1): N-terminal acetylation
  MOD_RES (20)..(20): C-terminal amidation
FQSKGNVNVDGYFERLRAKL

SEQ ID NO: 886 - protein, 20 aa, Artificial Sequence
  Synthetic peptide
  MOD_RES (1)..(1): N-terminal acetylation
  MOD_RES (20)..(20): C-terminal amidation
FQSKGNVFNDGYFERLRAKL

SEQ ID NO: 887 - protein, 20 aa, Artificial Sequence
  Synthetic peptide
  MOD_RES (1)..(1): N-terminal acetylation
  MOD_RES (20)..(20): C-terminal amidation
FQSKGNVFVDNYFERLRAKL

SEQ ID NO: 888 - protein, 20 aa, Artificial Sequence
  Synthetic peptide
  MOD_RES (1)..(1): N-terminal acetylation
  MOD_RES (20)..(20): C-terminal amidation
FQSKGNVFVDGNFERLRAKL

SEQ ID NO: 889 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERNRAKL

SEQ ID NO: 890 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRANL

SEQ ID NO: 891 - protein, 20 aa, Artificial Sequence
  Synthetic peptide
  MOD_RES (1)..(1): N-terminal acetylation
  MOD_RES (20)..(20): C-terminal amidation
PQSKGNVFVDGYFERLRAKL

SEQ ID NO: 892 - protein, 20 aa, Artificial Sequence
  Synthetic peptide
  MOD_RES (1)..(1): N-terminal acetylation
  MOD_RES (20)..(20): C-terminal amidation
FPSKGNVFVDGYFERLRAKL

SEQ ID NO: 893 - protein, 20 aa, Artificial Sequence
  Synthetic peptide
  MOD_RES (1)..(1): N-terminal acetylation
  MOD_RES (20)..(20): C-terminal amidation
FQPKGNVFVDGYFERLRAKL

SEQ ID NO: 894 - protein, 20 aa, Artificial Sequence
  Synthetic peptide
  MOD_RES (1)..(1): N-terminal acetylation
  MOD_RES (20)..(20): C-terminal amidation
FQSKGPVFVDGYFERLRAKL

SEQ ID NO: 895 - protein, 20 aa, Artificial Sequence
  Synthetic peptide
  MOD_RES (1)..(1): N-terminal acetylation
  MOD_RES (20)..(20): C-terminal amidation
FQSKGNVPVDGYFERLRAKL

SEQ ID NO: 896 - protein, 20 aa, Artificial Sequence
  Synthetic peptide
  MOD_RES (1)..(1): N-terminal acetylation
  MOD_RES (20)..(20): C-terminal amidation
FQSKGNVFPDGYFERLRAKL

SEQ ID NO: 897 - protein, 20 aa, Artificial Sequence
  Synthetic peptide
  MOD_RES (1)..(1): N-terminal acetylation
  MOD_RES (20)..(20): C-terminal amidation
FQSKGNVFVDGPFERLRAKL

SEQ ID NO: 898 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERPRAKL

SEQ ID NO: 899 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLPAKL

SEQ ID NO: 900 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRPKL

SEQ ID NO: 901 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAPL

SEQ ID NO: 902 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKP

SEQ ID NO: 903 - protein, 20 aa, Artificial Sequence
  Synthetic peptide
  MOD_RES (1)..(1): N-terminal acetylation
  MOD_RES (20)..(20): C-terminal amidation
FQSKGNVQVDGYFERLRAKL

SEQ ID NO: 904 - protein, 20 aa, Artificial Sequence
  Synthetic peptide
  MOD_RES (1)..(1): N-terminal acetylation
  MOD_RES (20)..(20): C-terminal amidation
FQSKGNVFVDGQFERLRAKL

SEQ ID NO: 905 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERQRAKL

SEQ ID NO: 906 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAQL

SEQ ID NO: 907 - protein, 20 aa, Artificial Sequence
  Synthetic peptide
  MOD_RES (1)..(1): N-terminal acetylation
  MOD_RES (20)..(20): C-terminal amidation
FQSKGNVFVDRYFERLRAKL

SEQ ID NO: 908 - protein, 20 aa, Artificial Sequence
  Synthetic peptide
  MOD_RES (1)..(1): N-terminal acetylation
  MOD_RES (20)..(20): C-terminal amidation
FQSKGNVFVDGRFERLRAKL

SEQ ID NO: 909 - protein, 20 aa, Artificial Sequence
  Synthetic peptide
  MOD_RES (1)..(1): N-terminal acetylation
  MOD_RES (20)..(20): C-terminal amidation
FQSKGNVSVDGYFERLRAKL

SEQ ID NO: 910 - protein, 20 aa, Artificial Sequence
  Synthetic peptide
  MOD_RES (1)..(1): N-terminal acetylation
  MOD_RES (20)..(20): C-terminal amidation
FQSKGNVFVDGSFERLRAKL

SEQ ID NO: 911 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFESLRAKL

SEQ ID NO: 912 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERSRAKL

SEQ ID NO: 913 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRASL

SEQ ID NO: 914 - protein, 20 aa, Artificial Sequence
  Synthetic peptide
  MOD_RES (1)..(1): N-terminal acetylation
  MOD_RES (20)..(20): C-terminal amidation
FTSKGNVFVDGYFERLRAKL

SEQ ID NO: 915 - protein, 20 aa, Artificial Sequence
  Synthetic peptide
  MOD_RES (1)..(1): N-terminal acetylation
  MOD_RES (20)..(20): C-terminal amidation
FQSKGNVTVDGYFERLRAKL

SEQ ID NO: 916 - protein, 20 aa, Artificial Sequence
  Synthetic peptide
  MOD_RES (1)..(1): N-terminal acetylation
  MOD_RES (20)..(20): C-terminal amidation
FQSKGNVFVDTYFERLRAKL

SEQ ID NO: 917 - protein, 20 aa, Artificial Sequence
  Synthetic peptide
  MOD_RES (1)..(1): N-terminal acetylation
  MOD_RES (20)..(20): C-terminal amidation
FQSKGNVFVDGTFERLRAKL

SEQ ID NO: 918 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFETLRAKL

SEQ ID NO: 919 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERTRAKL

SEQ ID NO: 920 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRATL

SEQ ID NO: 921 - protein, 20 aa, Artificial Sequence
  Synthetic peptide
  MOD_RES (1)..(1): N-terminal acetylation
  MOD_RES (20)..(20): C-terminal amidation
FVSKGNVFVDGYFERLRAKL

SEQ ID NO: 922 - protein, 20 aa, Artificial Sequence
  Synthetic peptide
  MOD_RES (1)..(1): N-terminal acetylation
  MOD_RES (20)..(20): C-terminal amidation
FQSKGNVVVDGYFERLRAKL

SEQ ID NO: 923 - protein, 20 aa, Artificial Sequence
  Synthetic peptide
  MOD_RES (1)..(1): N-terminal acetylation
  MOD_RES (20)..(20): C-terminal amidation
FQSKGNVFVDVYFERLRAKL

SEQ ID NO: 924 - protein, 20 aa, Artificial Sequence
  Synthetic peptide
  MOD_RES (1)..(1): N-terminal acetylation
  MOD_RES (20)..(20): C-terminal amidation
FQSKGNVFVDGVFERLRAKL

SEQ ID NO: 925 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEVLRAKL

SEQ ID NO: 926 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAVL

SEQ ID NO: 927 - protein, 20 aa, Artificial Sequence
  Synthetic peptide
  MOD_RES (1)..(1): N-terminal acetylation
  MOD_RES (20)..(20): C-terminal amidation
FWSKGNVFVDGYFERLRAKL

SEQ ID NO: 928 - protein, 20 aa, Artificial Sequence
  Synthetic peptide
  MOD_RES (1)..(1): N-terminal acetylation
  MOD_RES (20)..(20): C-terminal amidation
FQSKGNVFVDGWFERLRAKL

SEQ ID NO: 929 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEWLRAKL

SEQ ID NO: 930 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAWL

SEQ ID NO: 931 - protein, 20 aa, Artificial Sequence
  Synthetic peptide
  MOD_RES (1)..(1): N-terminal acetylation
  MOD_RES (20)..(20): C-terminal amidation
FYSKGNVFVDGYFERLRAKL

SEQ ID NO: 932 - protein, 20 aa, Artificial Sequence
  Synthetic peptide
  MOD_RES (1)..(1): N-terminal acetylation
  MOD_RES (20)..(20): C-terminal amidation
FQSKGNVFVDYYFERLRAKL

SEQ ID NO: 933 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFEYLRAKL

SEQ ID NO: 934 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERYRAKL

SEQ ID NO: 935 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAYL

SEQ ID NO: 936 - protein, 20 aa, Artificial Sequence
  Synthetic peptide
  MOD_RES (1)..(1): N-terminal acetylation
  MOD_RES (9)..(9): D-Val
  MOD_RES (20)..(20): C-terminal amidation
FQSKGNVFVFGYFERLRAKL

SEQ ID NO: 937 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKD

SEQ ID NO: 938 - protein, 20 aa, Artificial Sequence
  Synthetic peptide
  MOD_RES (1)..(1): N-terminal acetylation
  MOD_RES (20)..(20): C-terminal amidation
LQSKTNVFVDGYFERLAAKL

SEQ ID NO: 939 - protein, 20 aa, Artificial Sequence
  Synthetic peptide
  MOD_RES (1)..(1): N-terminal acetylation
  MOD_RES (20)..(20): C-terminal amidation
FQSKFNVFVDGYTERLAAKL

SEQ ID NO: 940 - protein, 20 aa, Artificial Sequence
  Synthetic peptide
  MOD_RES (1)..(1): N-terminal acetylation
  MOD_RES (20)..(20): C-terminal amidation
FQSKHNVFVDGHFERLAAKL

SEQ ID NO: 941 - protein, 20 aa, Artificial Sequence
  Synthetic peptide
  MOD_RES (1)..(1): N-terminal acetylation
  MOD_RES (20)..(20): C-terminal amidation
FQSVHNVFVDGYFERPAAKL

SEQ ID NO: 942 - protein, 20 aa, Artificial Sequence
  Synthetic peptide
  MOD_RES (1)..(1): N-terminal acetylation
  MOD_RES (20)..(20): C-terminal amidation
FQSKYNVFVDEYFERLAAKL

SEQ ID NO: 943 - protein, 20 aa, Artificial Sequence
  Synthetic peptide
  MOD_RES (1)..(1): N-terminal acetylation
  MOD_RES (20)..(20): C-terminal amidation
FQSKPNVFVDGYFERLAAKL

SEQ ID NO: 944 - protein, 20 aa, Artificial Sequence
  Synthetic peptide
  MOD_RES (1)..(1): N-terminal acetylation
  MOD_RES (20)..(20): C-terminal amidation
HQQFKNVFVDGYFERLAAKL

SEQ ID NO: 945 - protein, 20 aa, Artificial Sequence
  Synthetic peptide
  MOD_RES (1)..(1): N-terminal acetylation
  MOD_RES (20)..(20): C-terminal amidation
FQSKHNVFVDAYFERLRAKL

SEQ ID NO: 946 - protein, 20 aa, Artificial Sequence
  Synthetic peptide
  MOD_RES (1)..(1): N-terminal acetylation
  MOD_RES (20)..(20): C-terminal amidation
FQSKKNVFVDGYSERLRAKL

SEQ ID NO: 947 - protein, 20 aa, Artificial Sequence
  Synthetic peptide
  MOD_RES (1)..(1): N-terminal acetylation
  MOD_RES (20)..(20): C-terminal amidation
FQSKGNVCVDGYFERLRAKL

SEQ ID NO: 948 - protein, 20 aa, Artificial Sequence
  Synthetic peptide
  MOD_RES (1)..(1): N-terminal acetylation
  MOD_RES (20)..(20): C-terminal amidation
FQSKGNVFCDGYFERLRAKL

SEQ ID NO: 949 - protein, 20 aa, Artificial Sequence
  Synthetic peptide
  MOD_RES (1)..(1): N-terminal acetylation
  MOD_RES (20)..(20): C-terminal amidation
FQSKGNVFVDGCFERLRAKL

SEQ ID NO: 950 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFECLRAKL

SEQ ID NO: 951 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRACL

SEQ ID NO: 952 - protein, 20 aa, Artificial Sequence
  Synthetic peptide
  MOD_RES (1)..(1): N-terminal acetylation
  MOD_RES (20)..(20): C-terminal amidation
FQSCKNVFVDGYFERLCAKL

SEQ ID NO: 953 - protein, 20 aa, Artificial Sequence
  Synthetic peptide
  MOD_RES (1)..(1): N-terminal acetylation
  MOD_RES (20)..(20): C-terminal amidation
FQSAYNVFVDGYFERLCAKL

SEQ ID NO: 954 - protein, 20 aa, Artificial Sequence
  Synthetic peptide
  MOD_RES (1)..(1): N-terminal acetylation
  MOD_RES (20)..(20): C-terminal amidation
FQSVHNVFVDGYFERPCAKL

SEQ ID NO: 955 - protein, 20 aa, Artificial Sequence
  Synthetic peptide
  MOD_RES (1)..(1): N-terminal acetylation
  MOD_RES (20)..(20): C-terminal amidation
FQSKYNVFVDEYFERLCAKL

SEQ ID NO: 956 - protein, 20 aa, Artificial Sequence
  Synthetic peptide
  MOD_RES (1)..(1): N-terminal acetylation
  MOD_RES (8)..(8): Xaa is 2-Amino-isobutyric acid
  MOD_RES (17)..(17): Xaa is 2-Amino-isobutyric acid
  MOD_RES (20)..(20): C-terminal amidation
FQSKGNVXVDGYFERLXAKL

SEQ ID NO: 957 - protein, 20 aa, Artificial Sequence
  Synthetic peptide
  MOD_RES (1)..(1): N-terminal acetylation
  MOD_RES (12)..(12): Xaa is 2-Amino-isobutyric acid
  MOD_RES (17)..(17): Xaa is 2-Amino-isobutyric acid
  MOD_RES (20)..(20): C-terminal amidation
FQSKGNVFVDGXFERLXAKL

SEQ ID NO: 958 - protein, 20 aa, Artificial Sequence
  Synthetic peptide
  MOD_RES (1)..(1): N-terminal acetylation
  MOD_RES (15)..(15): Xaa is 2-Amino-isobutyric acid
  MOD_RES (17)..(17): Xaa is 2-Amino-isobutyric acid
  MOD_RES (20)..(20): C-terminal amidation
FQSKGNVFVDGYFEXLXAKL

SEQ ID NO: 959 - protein, 20 aa, Artificial Sequence
  Synthetic peptide
  MOD_RES (1)..(1): N-terminal acetylation
  MOD_RES (17)..(17): Xaa is 2-Amino-isobutyric acid
  MOD_RES (19)..(19): Xaa is 2-Amino-isobutyric acid
  MOD_RES (20)..(20): C-terminal amidation
FQSKGNVFVDGYFERLXAXL

SEQ ID NO: 960 - protein, 11 aa, Artificial Sequence
  Synthetic peptide
  MOD_RES (1)..(1): N-terminal acetylation
  MOD_RES (11)..(11): C-terminal amidation
DGYFERLRAKL

SEQ ID NO: 961 - protein, 7 aa, Artificial Sequence
  Synthetic peptide
  MOD_RES (1)..(1): N-terminal acetylation
  MOD_RES (7)..(7): C-terminal amidation
FQSKKNV

SEQ ID NO: 962 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGVGRLQVAFQSKKNVFVFGYFERLRAKLTS

SEQ ID NO: 963 - protein, 33 aa, Artificial Sequence
  Synthetic peptide
  MOD_RES (1)..(1): N-terminal acetylation
  MOD_RES (32)..(32): Xaa is (13-Amino-4,7,10-trioxa-tridecayl)-succinamic acid
  MOD_RES (33)..(33): Xaa is Lysin(biotin)
  MOD_RES (33)..(33): C-terminal amidation
SGVGRLQVAFQSKKNVFVFGYFERLRAKLTSXX

SEQ ID NO: 964 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XAFQSKKNVFVFGYFERLRAK

SEQ ID NO: 965 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKKNVFVFGYFERLRAKL

SEQ ID NO: 966 - protein, 22 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (2)..(2): Xaa is (13-Amino-4,7,10-trioxa-tridecayl)-succinamic acid
  MOD_RES (22)..(22): C-terminal amidation
XXQSKKNVFVFGYFERLRAKLT

SEQ ID NO: 967 - protein, 19 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (19)..(19): C-terminal amidation
XQSKKNVFVFGYFERLRAK

SEQ ID NO: 968 - protein, 25 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (25)..(25): C-terminal amidation
XKKFQSKKNVFVFGYFERLRAKLKK

SEQ ID NO: 969 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XGKNAKFYLFESLRQVKFVFR

SEQ ID NO: 970 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XYKFSFNKELFKQARLRFVGV

SEQ ID NO: 971 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XSGVGRLQVAFQSKKNVFVFG

SEQ ID NO: 972 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKKNVFVDGYFERLRAKL

SEQ ID NO: 973 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKNNVFVFGYFERLRAKL

SEQ ID NO: 974 - protein, 21 aa, Artificial Sequence
  Synthetic peptide
  MOD_RES (1)..(1): C-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKKNVFVFGYFDRLRAKL

SEQ ID NO: 975 - protein, 20 aa, Artificial Sequence
  Synthetic peptide
  MOD_RES (1)..(1): N-terminal Biotinyl
  MOD_RES (20)..(20): C-terminal amidation
FQSKKNVFVFGYFERLRAKL

SEQ ID NO: 976 - protein, 20 aa, Artificial Sequence
  Synthetic peptide
  MOD_RES (1)..(1): N-terminal acetylation
  MOD_RES (20)..(20): C-terminal amidation
FQSKDNVFVDGYFDRLRAKL

SEQ ID NO: 977 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XFQSKGNVFVDGYFERLRAKL

SEQ ID NO: 978 - protein, 20 aa, Artificial Sequence
  Synthetic peptide
  MOD_RES (1)..(1): N-terminal acetylation
  MOD_RES (20)..(20): C-terminal N-propyl
FQSKGNVFVFGYFERLRAKL

SEQ ID NO: 979-1000 - skipped (22 entries)

SEQ ID NO: 1001 - protein, 35 aa, Artificial Sequence
  Synthetic peptide
  MOD_RES (1)..(1): N-terminal acetylation
  DISULFID (12)..(23): Cys residues linked via disulfide bond
  MOD_RES (35)..(35): C-terminal amidation
KKSGASRYKWFCGMRDMKGTMSCVWVKFRYDTSKK

SEQ ID NO: 1002 - protein, 28 aa, Artificial Sequence
  Synthetic peptide
  MOD_RES (1)..(1): N-terminal acetylation
  DISULFID (10)..(21): Cys residues linked via disulfide bond
  MOD_RES (28)..(28): C-terminal amidation
SGASRYKWFCGMRDMKGTMSCVWVKFRY

SEQ ID NO: 1003 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKF

SEQ ID NO: 1004 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCAMRDMKGTMSCVWVKF

SEQ ID NO: 1005 - protein, 23 aa, Artificial Sequence
  Synthetic peptide
  MOD_RES (1)..(1): N-terminal amidation
  DISULFID (7)..(18): Cys residues linked via disulfide bond
  MOD_RES (23)..(23): C-terminal amidation
SRYKWFCAMRDMKGTMSCVWVKF

SEQ ID NO: 1006 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMPDMKGTMSCVWVKF

SEQ ID NO: 1007 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
DRYKWFCGMRDMKGTMSCVWVKF

SEQ ID NO: 1008 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMDGTMSCVWVKF

SEQ ID NO: 1009 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKD

SEQ ID NO: 1010 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SFYKWFCGMRDMKGTMSCVWVKF

SEQ ID NO: 1011 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRFKWFCGMRDMKGTMSCVWVKF

SEQ ID NO: 1012 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDFKGTMSCVWVKF

SEQ ID NO: 1013 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTFSCVWVKF

SEQ ID NO: 1014 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
GRYKWFCGMRDMKGTMSCVWVKF

SEQ ID NO: 1015 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMGGTMSCVWVKF

SEQ ID NO: 1016 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
KRYKWFCGMRDMKGTMSCVWVKF

SEQ ID NO: 1017 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMKDMKGTMSCVWVKF

SEQ ID NO: 1018 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
LRYKWFCGMRDMKGTMSCVWVKF

SEQ ID NO: 1019 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDLKGTMSCVWVKF

SEQ ID NO: 1020 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKL

SEQ ID NO: 1021 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCSMRDMKGTMSCVWVKF

SEQ ID NO: 1022 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMSGTMSCVWVKF

SEQ ID NO: 1023 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVPF

SEQ ID NO: 1024 - protein, 23 aa, Artificial Sequence
  Synthetic peptide
  DISULFID (7)..(18): Cys residues linked via disulfide bond
  MOD_RES (23)..(23): C-terminal amidation
SRYKWFCGMRDMKGTMSCVWVKF

SEQ ID NO: 1025 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Leu
  MOD_RES (23)..(23): C-terminal amidation
SRYKWFCGMRDLKGTMSCVWVKF

SEQ ID NO: 1026 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SMYKWHCGMRDMKGTYSCVWVKF

SEQ ID NO: 1027 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
FHYKWHCGMRDMKGTYSCVWVKF

SEQ ID NO: 1028 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIMSCAWVKF

SEQ ID NO: 1029 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIMSCVWVKY

SEQ ID NO: 1030 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIDSCVWVRF

SEQ ID NO: 1031 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGIMSCVWVKA

SEQ ID NO: 1032 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTMTCVWVKF

SEQ ID NO: 1033 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTMSCVWVKS

SEQ ID NO: 1034 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SHYKWHCAMRDMKGTYSCVWVKF

SEQ ID NO: 1035 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGVRDMKGTMSCVWVKS

SEQ ID NO: 1036 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
GHYKWHCGMRDMKGTFSCVWVF

SEQ ID NO: 1037 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
AYYKWHCGMRDLKGTMSCVWVKS

SEQ ID NO: 1038 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTYSCVWVKM

SEQ ID NO: 1039 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SHYKWHCGMRDMKGIMSCVWVF

SEQ ID NO: 1040 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
FYYKWHCGMRDMKGTMSCAWVKF

SEQ ID NO: 1041 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTDSCVWVWY

SEQ ID NO: 1042 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SHYKWHCGMRDMKGTMSCAWVKF

SEQ ID NO: 1043 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
HYYKWHCGMRDMKGTMSCVWVKS

SEQ ID NO: 1044 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCAMRDMKGTMTCVWVKF

SEQ ID NO: 1045 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SYYKWHCGMRDMKGTMSCVWVLF

SEQ ID NO: 1046 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SHYKWHCAMRDMKGTMSCAWVKF

SEQ ID NO: 1047 - protein, 31 aa, Artificial Sequence
  Synthetic peptide
  MOD_RES (1)..(1): N-terminal acetylation
  DISULFID (10)..(22): Cys residues linked via disulfide bond
  MOD_RES (31)..(31): C-terminal amidation
SGASRYKWFCGMRDMKGTMSCVWVKFRYDTS

SEQ ID NO: 1048 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
ARYKWFCGMRDMKGTMSCVWVKF

SEQ ID NO: 1049 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCAWVKF

SEQ ID NO: 1050 - protein, 22 aa, Artificial Sequence
  Synthetic peptide
  MOD_RES (1)..(1): N-terminal acetylation
  DISULFID (6)..(17): Cys residues linked via disulfide bond
  MOD_RES (22)..(22): C-terminal amidation
RYKWFCGMRDMKGTMSCVWVKF

SEQ ID NO: 1051 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Met
  MOD_RES (23)..(23): C-terminal amidation
SRYKWFCGMRDMKGTMSCVWVKF

SEQ ID NO: 1052 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKDTMSCVWVKF

SEQ ID NO: 1053 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
FRYKWFCGMRDMKGTMSCVWVKF

SEQ ID NO: 1054 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMFGTMSCVWVKF

SEQ ID NO: 1055 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGGMSCVWVKF

SEQ ID NO: 1056 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SKYKWFCGMRDMKGTMSCVWVKF

SEQ ID NO: 1057 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDKKGTMSCVWVKF

SEQ ID NO: 1058 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGKMSCVWVKF

SEQ ID NO: 1059 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTKSCVWVKF

SEQ ID NO: 1060 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SLYKWFCGMRDMKGTMSCVWVKF

SEQ ID NO: 1061 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWLCGMRDMKGTMSCVWVKF

SEQ ID NO: 1062 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMLDMKGTMSCVWVKF

SEQ ID NO: 1063 - protein, 23 aa, Artificial Sequence
  Synthetic peptide
  MOD_RES (1)..(1): N-terminal acetylation
  MOD_RES (23)..(23): C-terminal amidation
SRYKWFCGMRDMLGTMSCVWVKF

SEQ ID NO: 1064 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTLSCVWVKF

SEQ ID NO: 1065 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SSYKWFCGMRDMKGTMSCVWVKF

SEQ ID NO: 1066 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRSKWFCGMRDMKGTMSCVWVKF

SEQ ID NO: 1067 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDSKGTMSCVWVKF

SEQ ID NO: 1068 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGSMSCVWVKF

SEQ ID NO: 1069 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTSSCVWVKF

SEQ ID NO: 1070 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVSF

SEQ ID NO: 1071 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKS

SEQ ID NO: 1072 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
PRYKWFCGMRDMKGTMSCVWVKF

SEQ ID NO: 1073 - protein, 22 aa, Artificial Sequence
  Synthetic peptide
  DISULFID (6)..(17): Cys residues linked via disulfide bond
  MOD_RES (22)..(22): C-terminal amidation
RYKWFCGMRDMKGTMSCVWVKF

SEQ ID NO: 1074 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Phe
  MOD_RES (23)..(23): C-terminal amidation
SRYKWFCGMRDFKGTMSCVWVKF

SEQ ID NO: 1075 - protein, 28 aa, Artificial Sequence
  Synthetic peptide
  MOD_RES (1)..(1): N-terminal acetylation
  DISULFID (10)..(21): Cys residues linked via disulfide bond
  MOD_RES (28)..(28): C-terminal amidation
SGASRYKWFCGMRDMKGTMSCVWVKFRY

SEQ ID NO: 1076 - protein, 28 aa, Artificial Sequence
  Synthetic peptide
  MOD_RES (1)..(1): N-terminal acetylation
  DISULFID (7)..(18): Cys residues linked via disulfide bond
  MOD_RES (28)..(28): C-terminal amidation
SRYKWFCGMRDMKGTMSCVWVKFRYDTS

SEQ ID NO: 1077 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): Xaa is (S)-Norleucine
  MOD_RES (12)..(12): Xaa is (S)-Norleucine
  MOD_RES (16)..(16): Xaa is (S)-Norleucine
  MOD_RES (23)..(23): C-terminal amidation
SRYKWFCGXRDXKGTXSCVWVKF

SEQ ID NO: 1078 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SAYKWFCGMRDMKGTMSCVWVKF

SEQ ID NO: 1079 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMADMKGTMSCVWVKF

SEQ ID NO: 1080 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMAGTMSCVWVKF

SEQ ID NO: 1081 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGAMSCVWVKF

SEQ ID NO: 1082 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVAF

SEQ ID NO: 1083 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKA

SEQ ID NO: 1084 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDPKGTMSCVWVKF

SEQ ID NO: 1085 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDDKGTMSCVWVKF

SEQ ID NO: 1086 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTDSCVWVKF

SEQ ID NO: 1087 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCFWVKF

SEQ ID NO: 1088 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDGKGTMSCVWVKF

SEQ ID NO: 1089 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVGF

SEQ ID NO: 1090 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKG

SEQ ID NO: 1091 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWKCGMRDMKGTMSCVWVKF

SEQ ID NO: 1092 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGLMSCVWVKF

SEQ ID NO: 1093 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCLWVKF

SEQ ID NO: 1094 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWLKF

SEQ ID NO: 1095 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMSDMKGTMSCVWVKF

SEQ ID NO: 1096 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRSMKGTMSCVWVKF

SEQ ID NO: 1097 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCSWVKF

SEQ ID NO: 1098 - protein, 23 aa, Artificial Sequence
  Synthetic peptide
  MOD_RES (1)..(1): N-terminal acetylation
  DISULFID (7)..(18): Cys residues linked via disulfide bond
SRYKWFCGMRDMKGTMSCVWVKF

SEQ ID NO: 1099 - protein, 23 aa, Artificial Sequence
  Synthetic peptide
  DISULFID (7)..(18): Cys residues linked via disulfide bond
SRYKWFCGMRDMKGTMSCVWVKF

SEQ ID NO: 1100 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Pro
  MOD_RES (23)..(23): C-terminal amidation
SRYKWFCGPRDMKGTMSCVWVKF

SEQ ID NO: 1101 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Asp
  MOD_RES (23)..(23): C-terminal amidation
SRYKWFCGMRDDKGTMSCVWVKF

SEQ ID NO: 1102 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Lys
  MOD_RES (23)..(23): C-terminal amidation
SRYKWFCGMRDKKGTMSCVWVKF

SEQ ID NO: 1103 - protein, 25 aa, Artificial Sequence
  Synthetic peptide
  MOD_RES (1)..(1): N-terminal acetylation
  DISULFID (10)..(21): Cys residues linked via disulfide bond
  MOD_RES (25)..(25): C-terminal amidation
SGASRYKWFCGMRDMKGTMSCVWVK

SEQ ID NO: 1104 - protein, 31 aa, Artificial Sequence
  Synthetic peptide
  MOD_RES (1)..(1): N-terminal acetylation
  DISULFID (10)..(21): Cys residues linked via disulfide bond
  MOD_RES (12)..(12): Xaa is (S)-Noreleucine
  MOD_RES (15)..(15): Xaa is (S)-Noreleucine
  MOD_RES (19)..(19): Xaa is (S)-Noreleucine
  MOD_RES (31)..(31): C-terminal amidation
SGASRYKWFCGXRDXKGTXSCVWVKFRYDTS

SEQ ID NO: 1105 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRAKWFCGMRDMKGTMSCVWVKF

SEQ ID NO: 1106 - protein, 23 aa, Artificial Sequence
  Synthetic peptide
  MOD_RES (1)..(1): N-terminal acetylation
  MOD_RES (5)..(5): D-Ala
  DISULFID (7)..(18): Cys residues linked via disulfide bond
  MOD_RES (17)..(17): Xaa is Norleucine
  MOD_RES (23)..(23): C-terminal amidation
SRYAWFCGMRDMKGTMSCVWVKF

SEQ ID NO: 1107 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGARDMKGTMSCVWVKF

SEQ ID NO: 1108 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDAKGTMSCVWVKF

SEQ ID NO: 1109 - protein, 23 aa, Artificial Sequence
  Synthetic peptide
  MOD_RES (1)..(1): N-terminal acetylation
  MOD_RES (5)..(5): N-methyl-Gly
  DISULFID (7)..(18): Cys residues linked via disulfide bond
  MOD_RES (23)..(23): C-terminal amidation
SRYKWFCGMRDMKGTASCVWVKF

SEQ ID NO: 1110 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMACVWVKF

SEQ ID NO: 1111 - protein, 21 aa, Artificial Sequence
  Synthetic peptide
  MOD_RES (1)..(1): N-terminal acetylation
  DISULFID (5)..(16): Cys residues linked via disulfide bond
  MOD_RES (21)..(21): C-terminal amidation
YKWFCGMRDMKGTMSCVWVKF

SEQ ID NO: 1112 - protein, 23 aa, Artificial Sequence
  Synthetic peptide
  MOD_RES (1)..(1): N-terminal acetylation
  MOD_RES (7)..(7): Homo-Cys
  DISULFID (7)..(18): Cys residues linked via disulfide bond
  MOD_RES (23)..(23): C-terminal amidation
SRYKWFCGMRDMKGTMSCVWVKF

SEQ ID NO: 1113 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Met
  MOD_RES (23)..(23): C-terminal amidation
SRYKWFCGMRDMKGTMSCVWVKF

SEQ ID NO: 1114 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Lys
  MOD_RES (23)..(23): C-terminal amidation
SRYKWFCGMRDMKGTMSCVWVKF

SEQ ID NO: 1115 - protein, 25 aa, Artificial Sequence
  Synthetic peptide
  MOD_RES (1)..(1): N-terminal acetylation
  DISULFID (9)..(20): Cys residues linked via disulfide bond
GSSRYKWFCGMRDMKGTMSCVWVKF

SEQ ID NO: 1116 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SDYKWFCGMRDMKGTMSCVWVKF

SEQ ID NO: 1117 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYDWFCGMRDMKGTMSCVWVKF

SEQ ID NO: 1118 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGDMSCVWVKF

SEQ ID NO: 1119 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMDCVWVKF

SEQ ID NO: 1120 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVDF

SEQ ID NO: 1121 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYFWFCGMRDMKGTMSCVWVKF

SEQ ID NO: 1122 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKFTMSCVWVKF

SEQ ID NO: 1123 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGFMSCVWVKF

SEQ ID NO: 1124 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMFCVWVKF

SEQ ID NO: 1125 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVFVKF

SEQ ID NO: 1126 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SGYKWFCGMRDMKGTMSCVWVKF

SEQ ID NO: 1127 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYGWFCGMRDMKGTMSCVWVKF

SEQ ID NO: 1128 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMGDMKGTMSCVWVKF

SEQ ID NO: 1129 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRGMKGTMSCVWVKF

SEQ ID NO: 1130 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTGSCVWVKF

SEQ ID NO: 1131 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMGCVWVKF

SEQ ID NO: 1132 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRKKWFCGMRDMKGTMSCVWVKF

SEQ ID NO: 1133 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGKRDMKGTMSCVWVKF

SEQ ID NO: 1134 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKKTMSCVWVKF

SEQ ID NO: 1135 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMKCVWVKF

SEQ ID NO: 1136 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKK

SEQ ID NO: 1137 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRLKWFCGMRDMKGTMSCVWVKF

SEQ ID NO: 1138 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYLWFCGMRDMKGTMSCVWVKF

SEQ ID NO: 1139 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGLRDMKGTMSCVWVKF

SEQ ID NO: 1140 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKLTMSCVWVKF

SEQ ID NO: 1141 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMLCVWVKF

SEQ ID NO: 1142 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVLF

SEQ ID NO: 1143 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYSWFCGMRDMKGTMSCVWVKF

SEQ ID NO: 1144 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKSTMSCVWVKF

SEQ ID NO: 1145 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SPYKWFCGMRDMKGTMSCVWVKF

SEQ ID NO: 1146 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCQMRDMKGTMSCVWVKF

SEQ ID NO: 1147 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCRMRDMKGTMSCVWVKF

SEQ ID NO: 1148 - protein, 23 aa, Artificial Sequence
  Synthetic peptide
  MOD_RES (1)..(1): N-terminal acetylation
  DISULFID (5)..(16): Cys residues linked via disulfide bond
  MOD_RES (23)..(23): C-terminal amidation
SRYKWFCTMRDMKGTMSCVWVKF

SEQ ID NO: 1149 - protein, 21 aa, Artificial Sequence
  Synthetic peptide
  DISULFID (7)..(18): Cys residues linked via disulfide bond
  MOD_RES (21)..(21): C-terminal amidation
YKWFCGMRDMKGTMSCVWVKF

SEQ ID NO: 1150 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Ala
  MOD_RES (23)..(23): C-terminal amidation
SRYKWFCGARDMKGTMSCVWVKF

SEQ ID NO: 1151 - protein, 23 aa, Artificial Sequence
  Synthetic peptide
  MOD_RES (1)..(1): N-terminal acetylation
  MOD_RES (12)..(12): D-Ala
  MOD_RES (23)..(23): C-terminal amidation
SRYKWFCGMRDAKGTMSCVWVKF

SEQ ID NO: 1152 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Ser
  MOD_RES (23)..(23): C-terminal amidation
SRYKWFCGMRDSKGTMSCVWVKF

SEQ ID NO: 1153 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Asp
  MOD_RES (23)..(23): C-terminal amidation
SRYKWFCGMRDMDGTMSCVWVKF

SEQ ID NO: 1154 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Ser
  MOD_RES (23)..(23): C-terminal amidation
SRYKWFCGMRDMSGTMSCVWVKF

SEQ ID NO: 1155 - protein, 25 aa, Artificial Sequence
  Synthetic peptide
  MOD_RES (1)..(1): N-terminal acetylation
  DISULFID (4)..(15): Cys residues linked via disulfide bond
  MOD_RES (25)..(25): C-terminal amidation
KWFCGMRDMKGTMSCVWVKFRYDTS

SEQ ID NO: 1156 - protein, 20 aa, Artificial Sequence
  Synthetic peptide
  MOD_RES (1)..(1): N-terminal acetylation
  DISULFID (4)..(15): Cys residues linked via disulfide bond
  MOD_RES (20)..(20): C-terminal amidation
KWFCGMRDMKGTMSCVWVKF

SEQ ID NO: 1157 - protein, 23 aa, Artificial Sequence
  Synthetic peptide
  MOD_RES (1)..(1): N-terminal acetylation
  MOD_RES (23)..(23): C-terminal amidation
SRYKWFAGMRDMKGTMSCVWVKF

SEQ ID NO: 1158 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRAMKGTMSCVWVKF

SEQ ID NO: 1159 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKATMSCVWVKF

SEQ ID NO: 1160 - protein, 23 aa, Artificial Sequence
  Synthetic peptide
  MOD_RES (1)..(1): N-terminal acetylation
  MOD_RES (23)..(23): C-terminal amidation
SRYKWFCGMRDMKGTMSAVWVKF

SEQ ID NO: 1161 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWAKF

SEQ ID NO: 1162 - protein, 23 aa, Artificial Sequence
  Synthetic peptide
  MOD_RES (1)..(1): N-terminal acetylation
  DISULFID (10)..(15): Cys residues linked via disulfide bond
  MOD_RES (23)..(23): C-terminal amidation
SRYKWFGMRCDMKGCTMSVWVKF

SEQ ID NO: 1163 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (18)..(18): Homo-Cys
  MOD_RES (23)..(23): C-terminal amidation
SRYKWFCGMRDMKGTMSCVWVKF

SEQ ID NO: 1164 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SRYKWFCGMRDKGTMSCVWVKF

SEQ ID NO: 1165 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SRYKWFCGMRDMGTMSCVWVKF

SEQ ID NO: 1166 - protein, 22 aa, Artificial Sequence
  Synthetic peptide
  MOD_RES (1)..(1): N-terminal acetylation
  DISULFID (7)..(18): Cys residues linked via disulfide bond
  MOD_RES (22)..(22): C-terminal amidation
SRYKWFCGMRDMKGMSCVWVKF

SEQ ID NO: 1167 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (7)..(7): d-Cys
  MOD_RES (21)..(21): C-terminal amidation
SRYKWFCGMRDMKGTMSCVWVKF

SEQ ID NO: 1168 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (11)..(11): D-Asp
  MOD_RES (23)..(23): C-terminal amidation
SRYKWFCGMRDMKGTMSCVWVKF

SEQ ID NO: 1169 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (15)..(15): D-Thr
  MOD_RES (23)..(23): C-terminal amidation
SRYKWFCGMRDMKGTMSCVWVKF

SEQ ID NO: 1170 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (17)..(17): D-Ser
  MOD_RES (23)..(23): C-terminal amidation
SRYKWFCGMRDMKGTMSCVWVKF

SEQ ID NO: 1171 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (18)..(18): D-Cys
  MOD_RES (23)..(23): C-terminal amidation
SRYKWFCGMRDMKGTMSCVWVKF

SEQ ID NO: 1172 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRPMKGTMSCVWVKF

SEQ ID NO: 1173 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMPGTMSCVWVKF

SEQ ID NO: 1174 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGPMSCVWVKF

SEQ ID NO: 1175 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTPSCVWVKF

SEQ ID NO: 1176 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRDKWFCGMRDMKGTMSCVWVKF

SEQ ID NO: 1177 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGDRDMKGTMSCVWVKF

SEQ ID NO: 1178 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGFRDMKGTMSCVWVKF

SEQ ID NO: 1179 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMFDMKGTMSCVWVKF

SEQ ID NO: 1180 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRGKWFCGMRDMKGTMSCVWVKF

SEQ ID NO: 1181 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGGRDMKGTMSCVWVKF

SEQ ID NO: 1182 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCGWVKF

SEQ ID NO: 1183 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCKMRDMKGTMSCVWVKF

SEQ ID NO: 1184 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRKMKGTMSCVWVKF

SEQ ID NO: 1185 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRLMKGTMSCVWVKF

SEQ ID NO: 1186 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGSRDMKGTMSCVWVKF

SEQ ID NO: 1187 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRPKWFCGMRDMKGTMSCVWVKF

SEQ ID NO: 1188 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKP

SEQ ID NO: 1189 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCMMRDMKGTMSCVWVKF

SEQ ID NO: 1190 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCNMRDMKGTMSCVWVKF

SEQ ID NO: 1191 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCWMRDMKGTMSCVWVKF

SEQ ID NO: 1192 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Phe
  MOD_RES (23)..(23): C-terminal amidation
SRYKWFCGFRDMKGTMSCVWVKF

SEQ ID NO: 1193 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Lys
  MOD_RES (23)..(23): C-terminal amidation
SRYKWFCGKRDMKGTMSCVWVKF

SEQ ID NO: 1194 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Leu
  MOD_RES (23)..(23): C-terminal amidation
SRYKWFCGLRDMKGTMSCVWVKF

SEQ ID NO: 1195 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Ser
  MOD_RES (23)..(23): C-terminal amidation
SRYKWFCGSRDMKGTMSCVWVKF

SEQ ID NO: 1196 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): D-Pro
  MOD_RES (23)..(23): C-terminal amidation
SRYKWFCGMRDPKGTMSCVWVKF

SEQ ID NO: 1197 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Ala
  MOD_RES (23)..(23): C-terminal amidation
SRYKWFCGMRDMAGTMSCVWVKF

SEQ ID NO: 1198 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Phe
  MOD_RES (23)..(23): C-terminal amidation
SRYKWFCGMRDMFGTMSCVWVKF

SEQ ID NO: 1199 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Leu
  MOD_RES (23)..(23): C-terminal amidation
SRYKWFCGMRDMLGTMSCVWVKF

SEQ ID NO: 1200 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): D-Pro
  MOD_RES (23)..(23): C-terminal amidation
SRYKWFCGMRDMPGTMSCVWVKF

SEQ ID NO: 1201 - protein, 24 aa, Artificial Sequence
  Synthetic peptide
  MOD_RES (1)..(1): N-terminal acetylation
  MOD_RES (24)..(24): C-terminal amidation
KKSRYKWFCGMRDMKGTMSCVWKK

SEQ ID NO: 1202 - protein, 24 aa, Artificial Sequence
  Synthetic peptide
  MOD_RES (1)..(1): N-terminal acetylation
  MOD_RES (24)..(24): C-terminal amidation
KKKWFCGMRDMKGTMSCVWVKFKK

SEQ ID NO: 1203 - protein, 20 aa, Artificial Sequence
  Synthetic peptide
  MOD_RES (1)..(1): N-terminal acetylation
  DISULFID (4)..(15): Cys residues linked via disulfide bond
  MOD_RES (20)..(20): C-terminal amidation
KWFCGMRDMKGTMSCVWVKF

SEQ ID NO: 1204 - protein, 31 aa, Artificial Sequence
  Synthetic peptide
  MOD_RES (1)..(1): N-terminal acetylation
  MOD_RES (31)..(31): C-terminal amidation
SGASRYKWFSGMRDMKGTMSSVWVKFRYDTS

SEQ ID NO: 1205 - protein, 20 aa, Artificial Sequence
  Synthetic peptide
  MOD_RES (1)..(1): N-terminal acetylation
  MOD_RES (6)..(6): Xaa is (S)-Norleucine
  MOD_RES (9)..(9): Xaa is (S)-Norleucine
  MOD_RES (13)..(13): Xaa is (S)-Norleucine
  MOD_RES (20)..(20): C-terminal amidation
KWFSGXRDXKGTXSSVWVKF

SEQ ID NO: 1206 - protein, 20 aa, Artificial Sequence
  Synthetic peptide
  MOD_RES (1)..(1): N-terminal acetylation
  MOD_RES (20)..(20): C-terminal amidation
SRYKWFCGMRDMKGTMSCVW

SEQ ID NO: 1207 - protein, 20 aa, Artificial Sequence
  Synthetic peptide
  MOD_RES (1)..(1): N-terminal acetylation
  MOD_RES (20)..(20): C-terminal amidation
KWFCGMRDMKGTMSCVWVKF

SEQ ID NO: 1208 - protein, 31 aa, Artificial Sequence
  Synthetic peptide
  MOD_RES (1)..(1): N-terminal acetylation
  MOD_RES (12)..(12): Xaa is (S)-Norleucine
  MOD_RES (15)..(15): Xaa is (S)-Norleucine
  MOD_RES (19)..(19): Xaa is (S)-Norleucine
  MOD_RES (31)..(31): C-terminal amidation
SGASRYKWFSGXRDXKGTXSSVWVKFRYDTS

SEQ ID NO: 1209 - protein, 20 aa, Artificial Sequence
  Synthetic peptide
  MOD_RES (1)..(1): N-terminal acetylation
  DISULFID (4)..(15): Cys residues linked via disulfide bond
  MOD_RES (6)..(6): Xaa is (S)-Norleucine
  MOD_RES (9)..(9): Xaa is (S)-Norleucine
  MOD_RES (13)..(13): Xaa is (S)-Norleucine
  MOD_RES (20)..(20): C-terminal amidation
KWFCGXRDXKGTXSCVWVKF

SEQ ID NO: 1210 - protein, 23 aa, Artificial Sequence
  Synthetic peptide
  MOD_RES (1)..(1): N-terminal acetylation
  MOD_RES (9)..(9): Xaa is (S)-Norleucine
  MOD_RES (12)..(12): Xaa is (S)-Norleucine
  MOD_RES (16)..(16): Xaa is (S)-Norleucine
  MOD_RES (23)..(23): C-terminal amidation
SRYKWFSGXRDXKGTXSSVWVKF

SEQ ID NO: 1211 - protein, 31 aa, Artificial Sequence
  Synthetic peptide
  MOD_RES (1)..(1): N-terminal acetylation
  DISULFID (10)..(21): Cys residues linked via disulfide bond
  MOD_RES (31)..(31): C-terminal amidation
RKRDVSGKMCWSGFGSKWFRCADMMTYYSVT

SEQ ID NO: 1212 - protein, 31 aa, Artificial Sequence
  Synthetic peptide
  MOD_RES (1)..(1): N-terminal acetylation
  DISULFID (10)..(21): Cys residues linked via disulfide bond
  MOD_RES (31)..(31): C-terminal amidation
RWSGKSTYSCDAMVRRMGMKCFSFGWTDVYK

SEQ ID NO: 1213 - protein, 31 aa, Artificial Sequence; identical to SEQ ID NO: 1047
  Synthetic peptide
  MOD_RES (1)..(1): N-terminal acetylation
  MOD_RES (31)..(31): C-terminal amidation

SEQ ID NO: 1214 - protein, 24 aa, Artificial Sequence
  Synthetic peptide
  MOD_RES (1)..(1): N-terminal acetylation
  MOD_RES (24)..(24): C-terminal amidation
KKSGASRYKWFCGMRDMKGTMSKK

SEQ ID NO: 1215 - protein, 24 aa, Artificial Sequence
  Synthetic peptide
  MOD_RES (1)..(1): N-terminal acetylation
  MOD_RES (24)..(24): C-terminal amidation
KKCGMRDMKGTMSCVWVKFRYDKK

SEQ ID NO: 1216 - protein, 24 aa, Artificial Sequence
  Synthetic peptide
  MOD_RES (1)..(1): N-terminal acetylation
  MOD_RES (24)..(24): C-terminal amidation
KKMRDMKGTMSCVWVKFRYDTSKK

SEQ ID NO: 1217 - protein, 22 aa, Artificial Sequence
  Synthetic peptide
  MOD_RES (1)..(1): N-terminal acetylation
  DISULFID (10)..(21): Cys residues linked via disulfide bond
  MOD_RES (22)..(22): C-terminal amidation
SGASRYKWFCGMRDMKGTMSCV

SEQ ID NO: 1218 - protein, 19 aa, Artificial Sequence
  Synthetic peptide
  MOD_RES (1)..(1): N-terminal acetylation
  MOD_RES (19)..(19): C-terminal amidation
SGASRYKWFCGMRDMKGTM

SEQ ID NO: 1219 - protein, 22 aa, Artificial Sequence
  Synthetic peptide
  MOD_RES (1)..(1): N-terminal acetylation
  DISULFID (1)..(12): Cys residues linked via disulfide bond
  MOD_RES (22)..(22): C-terminal amidation
CGMRDMKGTMSCVWVKFRYDTS

SEQ ID NO: 1220 - protein, 19 aa, Artificial Sequence
  Synthetic peptide
  MOD_RES (1)..(1): N-terminal acetylation
  MOD_RES (19)..(19): C-terminal amidation
RDMKGTMSCVWVKFRYDTS

SEQ ID NO: 1221 - protein, 19 aa, Artificial Sequence
  Synthetic peptide
  MOD_RES (1)..(1): N-terminal acetylation
  MOD_RES (19)..(19): C-terminal amidation
RDMKGTMSCVWVKFRYDTS

SEQ ID NO: 1222 - protein, 20 aa, Artificial Sequence
  Synthetic peptide
  MOD_RES (1)..(1): N-terminal acetylation
  MOD_RES (20)..(20): C-terminal amidation
SGASRYKWFCGMRDMKGTMS

SEQ ID NO: 1223 - protein, 20 aa, Artificial Sequence
  Synthetic peptide
  MOD_RES (1)..(1): N-terminal acetylation
  DISULFID (7)..(18): Cys residues linked via disulfide bond
  MOD_RES (20)..(20): C-terminal amidation
SRYKWFCGMRDMKGTMSCVW

SEQ ID NO: 1224 - protein, 20 aa, Artificial Sequence
  Synthetic peptide
  MOD_RES (1)..(1): N-terminal acetylation
  DISULFID (1)..(12): Cys residues linked via disulfide bond
  MOD_RES (20)..(20): C-terminal amidation
CGMRDMKGTMSCVWVKFRYD

SEQ ID NO: 1225 - protein, 20 aa, Artificial Sequence
  Synthetic peptide
  MOD_RES (1)..(1): N-terminal acetylation
  MOD_RES (20)..(20): C-terminal amidation
MRDMKGTMSCVWVKFRYDTS

SEQ ID NO: 1226 - protein, 20 aa, Artificial Sequence
  Synthetic peptide
  MOD_RES (1)..(1): N-terminal acetylation
  MOD_RES (20)..(20): C-terminal amidation
MRDMKGTMSCVWVKFRYDTS

SEQ ID NO: 1227 - protein, 20 aa, Artificial Sequence
  Synthetic peptide
  MOD_RES (1)..(1): N-terminal acetylation
  MOD_RES (20)..(20): C-terminal amidation
CGMRDMKGTMSCVWVKFRYD

SEQ ID NO: 1228 - protein, 20 aa, Artificial Sequence
  Synthetic peptide
  MOD_RES (1)..(1): N-terminal acetylation
  MOD_RES (20)..(20): C-terminal amidation
KWFSGMRDMKGTMSSVWVKF

SEQ ID NO: 1229 - protein, 23 aa, Artificial Sequence
  Synthetic peptide
  MOD_RES (1)..(1): N-terminal acetylation
  MOD_RES (23)..(23): C-terminal amidation
SRYKWFSGMRDMKGTMSSVWVKF

SEQ ID NO: 1230 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (20)..(20): C-terminal amidation
SRYKAFCGMRDMKGTMSCVWVKF

SEQ ID NO: 1231 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWACGMRDMKGTMSCVWVKF

SEQ ID NO: 1232 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVAVKF

SEQ ID NO: 1233 - protein, 23 aa, Artificial Sequence
  Synthetic peptide
  MOD_RES (1)..(1): N-terminal acetylation
  DISULFID (9)..(18): Cys residues linked via disulfide bond
  MOD_RES (23)..(23): C-terminal amidation
SRYKWFGMCRDMKGTMSCVWVKF

SEQ ID NO: 1234 - protein, 23 aa, Artificial Sequence
  Synthetic peptide
  MOD_RES (1)..(1): N-terminal acetylation
  DISULFID (11)..(18): Cys residues linked via disulfide bond
  MOD_RES (23)..(23): C-terminal amidation
SRYKWFGMRDCMKGTMSCVWVKF

SEQ ID NO: 1235 - protein, 23 aa, Artificial Sequence
  Synthetic peptide
  MOD_RES (1)..(1): N-terminal acetylation
  DISULFID (13)..(18): Cys residues linked via disulfide bond
  MOD_RES (23)..(23): C-terminal amidation
SRYKWFGMRDMKCGTMSCVWVKF

SEQ ID NO: 1236 - protein, 23 aa, Artificial Sequence
  Synthetic peptide
  MOD_RES (1)..(1): N-terminal acetylation
  DISULFID (7)..(16): Cys residues linked via disulfide bond
  MOD_RES (23)..(23): C-terminal amidation
SRYKWFCGMRDMKGTCMSVWVKF

SEQ ID NO: 1237 - protein, 23 aa, Artificial Sequence
  Synthetic peptide
  MOD_RES (1)..(1): N-terminal acetylation
  DISULFID (7)..(14): Cys residues linked via disulfide bond
  MOD_RES (23)..(23): C-terminal amidation
SRYKWFCGMRDMKCGTMSVWVKF

SEQ ID NO: 1238 - protein, 23 aa, Artificial Sequence
  Synthetic peptide
  MOD_RES (1)..(1): N-terminal acetylation
  DISULFID (7)..(12): Cys residues linked via disulfide bond
  MOD_RES (23)..(23): C-terminal amidation
SRYKWFCGMRDCMKGTMSVWVKF

SEQ ID NO: 1239 - protein, 23 aa, Artificial Sequence
  Synthetic peptide
  MOD_RES (1)..(1): N-terminal acetylation
  DISULFID (8)..(17): Cys residues linked via disulfide bond
  MOD_RES (23)..(23): C-terminal amidation
SRYKWFGCMRDMKGTMCSVWVKF

SEQ ID NO: 1240 - protein, 23 aa, Artificial Sequence
  Synthetic peptide
  MOD_RES (1)..(1): N-terminal acetylation
  DISULFID (9)..(16): Cys residues linked via disulfide bond
  MOD_RES (23)..(23): C-terminal amidation
SRYKWFGMCRDMKGTCMSVWVKF

SEQ ID NO: 1241 - protein, 23 aa, Artificial Sequence
  Synthetic peptide
  MOD_RES (1)..(1): N-terminal acetylation
  MOD_RES (7)..(7): Homo-Cys
  DISULFID (7)..(18): Cys residues linked via disulfide bond
  MOD_RES (18)..(18): Homo-Cys
  MOD_RES (23)..(23): C-terminal amidation
SRYKWFCGMRDMKGTMSCVWVKF

SEQ ID NO: 1242 - protein, 23 aa, Artificial Sequence
  Synthetic peptide
  MOD_RES (1)..(1): N-terminal acetylation
  MOD_RES (7)..(7): Xaa is (S)-Diaminopropionic acid
  DISULFID (7)..(18): Cys residues linked via disulfide bond
  MOD_RES (23)..(23): C-terminal amidation
SRYKWFXGMRDMKGTMSDVWVKF

SEQ ID NO: 1243 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFKGMRDMKGTMSDVWVKF

SEQ ID NO: 1244 - protein, 22 aa, Artificial Sequence
  Synthetic peptide
  MOD_RES (1)..(1): N-terminal acetylation
  DISULFID (7)..(17): Cys residues linked via disulfide bond
  MOD_RES (22)..(22): C-terminal amidation
SRYKWFCMRDMKGTMSCVWVKF

SEQ ID NO: 1245 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (10)..(10): D-Arg
  MOD_RES (23)..(23): C-terminal amidation
SRYKWFCGMRDMKGTMSCVWVKF

SEQ ID NO: 1246 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (16)..(16): D-Met
  MOD_RES (23)..(23): C-terminal amidation
SRYKWFCGMRDMKGTMSCVWVKF

SEQ ID NO: 1247 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCPMRDMKGTMSCVWVKF

SEQ ID NO: 1248 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGPRDMKGTMSCVWVKF

SEQ ID NO: 1249 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKPTMSCVWVKF

SEQ ID NO: 1250 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMPCVWVKF

SEQ ID NO: 1251 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKDFCGMRDMKGTMSCVWVKF

SEQ ID NO: 1252 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWDCGMRDMKGTMSCVWVKF

SEQ ID NO: 1253 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCDMRDMKGTMSCVWVKF

SEQ ID NO: 1254 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMDDMKGTMSCVWVKF

SEQ ID NO: 1255 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCDWVKF

SEQ ID NO: 1256 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVDVKF

SEQ ID NO: 1257 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWDKF

SEQ ID NO: 1258 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKFFCGMRDMKGTMSCVWVKF

SEQ ID NO: 1259 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCFMRDMKGTMSCVWVKF

SEQ ID NO: 1260 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRFMKGTMSCVWVKF

SEQ ID NO: 1261 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWFKF

SEQ ID NO: 1262 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVFF

SEQ ID NO: 1263 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKGFCGMRDMKGTMSCVWVKF

SEQ ID NO: 1264 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWGCGMRDMKGTMSCVWVKF

SEQ ID NO: 1265 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVGVKF

SEQ ID NO: 1266 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWGKF

SEQ ID NO: 1267 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKKFCGMRDMKGTMSCVWVKF

SEQ ID NO: 1268 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCKWVKF

SEQ ID NO: 1269 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVKVKF

SEQ ID NO: 1270 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWKKF

SEQ ID NO: 1271 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKLFCGMRDMKGTMSCVWVKF

SEQ ID NO: 1272 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCLMRDMKGTMSCVWVKF

SEQ ID NO: 1273 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVLVKF

SEQ ID NO: 1274 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKSFCGMRDMKGTMSCVWVKF

SEQ ID NO: 1275 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWSCGMRDMKGTMSCVWVKF

SEQ ID NO: 1276 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVSVKF

SEQ ID NO: 1277 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWSKF

SEQ ID NO: 1278 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYPWFCGMRDMKGTMSCVWVKF

SEQ ID NO: 1279 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKPFCGMRDMKGTMSCVWVKF

SEQ ID NO: 1280 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWPCGMRDMKGTMSCVWVKF

SEQ ID NO: 1281 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCPWVKF

SEQ ID NO: 1282 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVPVKF

SEQ ID NO: 1283 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWPKF

SEQ ID NO: 1284 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (20)..(20): C-terminal amidation
SRYKWFCEMRDMKGTMSCVWVKF

SEQ ID NO: 1285 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCHMRDMKGTMSCVWVKF

SEQ ID NO: 1286 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCIMRDMKGTMSCVWVKF

SEQ ID NO: 1287 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCVMRDMKGTMSCVWVKF

SEQ ID NO: 1288 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCYMRDMKGTMSCVWVKF

SEQ ID NO: 1289 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): D-Asp
  MOD_RES (23)..(23): C-terminal amidation
SRYKWFCGDRDMKGTMSCVWVKF

SEQ ID NO: 1290 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  DISULFID (11)..(22): Cys residues linked via disufide bond
  MOD_RES (32)..(32): C-terminal amidation
XSGASRYKWFCGMRDMKGTMSCVWVKFRYDTS

SEQ ID NO: 1291 - protein, 24 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  DISULFID (8)..(19): Cys residues linked via disulfide bond
  MOD_RES (24)..(24): C-terminal amidation
XSRYKWFCGMRDMKGTMSCVWVKF

SEQ ID NO: 1292 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): C-terminal amidation
SRYKWFCGMRDMKGTMSCVWVKF

SEQ ID NO: 1293 - protein, 31 aa, Artificial Sequence
  Synthetic peptide
  MOD_RES (1)..(1): N-terminal acetylation
  MOD_RES (31)..(31): C-terminal amidation
SGGRKHKHFLRSNGKPSRALSSMHFWRWSTS

SEQ ID NO: 1294 - protein, 23 aa, Artificial Sequence
  Synthetic peptide
  MOD_RES (1)..(1): N-terminal acetylation
  MOD_RES (7)..(7): Xaa is (S)-2,4-Diaminobutyric acid
  MISC_FEATURE (7)..(18): (S)-2,4-Diaminobutyric acid and Asp are cyclic
  MOD_RES (23)..(23): C-terminal amidation
SRYKWFXGMRDMKGTMSDVWVKF

SEQ ID NO: 1295 - protein, 23 aa, Artificial Sequence
  Synthetic peptide
  MOD_RES (1)..(1): N-terminal acetylation
  MOD_RES (7)..(7): Xaa is ornithine
  MISC_FEATURE (7)..(18): Ornithine and Asp are cyclic
  MOD_RES (23)..(23): C-terminal amidation
SRYKWFXGMRDMKGTMSDVWVKF

SEQ ID NO: 1296 - protein, 23 aa, Artificial Sequence
  Synthetic peptide
  MOD_RES (1)..(1): N-terminal acetylation
  MOD_RES (7)..(7): Homo-Lys
  MISC_FEATURE (7)..(18): Homo-Lys and Asp are cyclic
  MOD_RES (23)..(23): C-terminal amidation
SRYKWFKGMRDMKGTMSDVWVKF

SEQ ID NO: 1297 - protein, 23 aa, Artificial Sequence
  Synthetic peptide
  MOD_RES (1)..(1): N-terminal acetylation
  MISC_FEATURE (7)..(18): Cys linked via diasulfide bond
  MOD_RES (23)..(23): C-terminal amidation
SHFKWHCAMRDMKGTMSCVWVKF

SEQ ID NO: 1298 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCGMRDMKGTMSCVWVKF

SEQ ID NO: 1299 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SQYKWHCAMRDMKGTMSCVWVKW

SEQ ID NO: 1300 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCGMRDMKGTYSCVWVKF

SEQ ID NO: 1301 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SHYKWHCAMRDMKGTMSCVWVKF

SEQ ID NO: 1302 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SHYKWHCAMRDMKGTMSCVWVKS

SEQ ID NO: 1303 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SHYKWHCAMRDMNGTMSCVWVKF

SEQ ID NO: 1304 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKRHCGMRDMKGTMSCVWVKF

SEQ ID NO: 1305 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SRYKWHCAMRDMAGTMSCVWVKE

SEQ ID NO: 1306 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCGMRDMKGTMSCAWVKF

SEQ ID NO: 1307 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SHYKWHCAMRDMTGTMSCVWVKF

SEQ ID NO: 1308 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
HYYKWHCGMLDMKGTMTCVWVKF

SEQ ID NO: 1309 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
HYYKWHCGMRDMKGTMSCVWVKF

SEQ ID NO: 1310 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
HYYKWHCGMRDMKGTYSCVWVKF

SEQ ID NO: 1311 - protein, 23 aa, Artificial Sequence
  Synthetic peptide
  MOD_RES (1)..(1): N-terminal acetylation
  MISC_FEATURE (7)..(19): Cys linked via disulfide bond
  MOD_RES (23)..(23): C-terminal amidation
SYYKWHCGMRDMKGIYSCVWVKF

SEQ ID NO: 1312 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCAMRDMKGTMSCVWVKF

SEQ ID NO: 1313 - protein, 24 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MISC_FEATURE (8)..(19): Cys linked via disulfide bond
  MOD_RES (24)..(24): C-terminal amidation
XSYYKWHCAMRDMKGTMTCVWVKF

SEQ ID NO: 1314 - protein, 23 aa, Artificial Sequence
  Synthetic peptide
  MOD_RES (1)..(1): N-terminal acetylation
  MOD_RES (1)..(1): N-ethylmaleiimido Cys
  MISC_FEATURE (7)..(18): Cys linked via disulfide bond
  MOD_RES (23)..(23): C-terminal amidation
CYYKWHCAMRDMKGTMTCVWVKF

SEQ ID NO: 1315 - protein, 22 aa, Artificial Sequence
  Synthetic peptide
  MOD_RES (1)..(1): N-terminal acetylation
  MOD_RES (1)..(1): N-ethylmaleiimido Cys
  MISC_FEATURE (6)..(17): Cys linked via disulfide bond
  MOD_RES (22)..(22): C-terminal amidation
CYKWHCAMRDMKGTMTCVWVKF

SEQ ID NO: 1316 - protein, 23 aa, Artificial Sequence
  Synthetic peptide
  MOD_RES (1)..(1): N-terminal pentynoic acid
  MISC_FEATURE (7)..(18): Cys linked via disulfide bond
  MOD_RES (23)..(23): C-terminal amidation
SYYKWHCAMRDMKGTMTCVWVKF

SEQ ID NO: 1317 - protein, 22 aa, Artificial Sequence
  Synthetic peptide
  MOD_RES (1)..(1): N-terminal pentynoic acid
  MISC_FEATURE (6)..(17): Cys linked via disulfide bond
  MOD_RES (22)..(22): C-terminal amidation
YYKWHCAMRDMKGTMTCVWVKF

SEQ ID NO: 1318 - protein, 21 aa, Artificial Sequence
  Synthetic peptide
  MOD_RES (1)..(1): N-terminal pentynoic acid
  MISC_FEATURE (5)..(16): Cys linked via disulfide bond
  MOD_RES (21)..(21): C-terminal amidation
YKWHCAMRDMKGTMTCVWVKF

SEQ ID NO: 1319 - protein, 22 aa, Artificial Sequence
  Synthetic peptide
  MOD_RES (1)..(1): Free N-terminus
  MISC_FEATURE (6)..(17): Cys linked via disulfide bond
  MOD_RES (22)..(22): C-terminal amidation
YYKWHCAMRDMKGTMTCVWVKF

SEQ ID NO: 1320 - protein, 23 aa, Artificial Sequence
  Synthetic peptide
  MOD_RES (1)..(1): Free N-terminus
  MISC_FEATURE (7)..(18): Cys linked via disulfide bond
  MOD_RES (23)..(23): C-terminal amidation
SYYKWHCAMRDMKGTMTCVWVKF

SEQ ID NO: 1321 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is norleucine
  MOD_RES (23)..(23): C-terminal amidation
SYYKWHCAXRDMKGTMTCVWVKF

SEQ ID NO: 1322 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (12)..(12): Xaa is norleucine
  MOD_RES (23)..(23): C-terminal amidation
SYYKWHCAMRDXKGTMTCVWVKF

SEQ ID NO: 1323 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (16)..(16): Xaa is norleucine
  MOD_RES (23)..(23): C-terminal amidation
SYYKWHCAMRDMKGTXTCVWVKF

SEQ ID NO: 1324 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is norleucine
  MOD_RES (12)..(12): Xaa is norleucine
  MOD_RES (16)..(16): Xaa is norleucine
  MOD_RES (23)..(23): C-terminal amidation
SYYKWHCAXRDXKGTXTCVWVKF

SEQ ID NO: 1325 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is methioninesulfone
  MOD_RES (23)..(23): C-terminal amidation
SYYKWHCAXRDMKGTMTCVWVKF

SEQ ID NO: 1326 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (12)..(12): Xaa is methioninesulfone
  MOD_RES (23)..(23): C-terminal amidation
SYYKWHCAMRDXKGTMTCVWVKF

SEQ ID NO: 1327 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (16)..(16): Xaa is methioninesulfone
  MOD_RES (23)..(23): C-terminal amidation
SYYKWHCAMRDMKGTXTCVWVKF

SEQ ID NO: 1328 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is methioninesulfone
  MOD_RES (12)..(12): Xaa is methioninesulfone
  MOD_RES (16)..(16): Xaa is methioninesulfone
  MOD_RES (23)..(23): C-terminal amidation
SYYKWHCAXRDXKGTXTCVWVKF

SEQ ID NO: 1329 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCAMRDLKGTMTCVWVKF

SEQ ID NO: 1330 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCAMRDMKGTFTCVWVKF

SEQ ID NO: 1331 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (23)..(23): C-terminal amidation
SYYKWHCAMRDLKGTFTCVWVKF

SEQ ID NO: 1332 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is norleucine
  MOD_RES (23)..(23): C-terminal amidation
SYYKWHCAXRDLKGTFTCVWVKF

SEQ ID NO: 1333 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is norleucine
  MOD_RES (12)..(12): Xaa is norleucine
  MOD_RES (23)..(23): C-terminal amidation
SYYKWHCAXRDXKGTFTCVWVKF

SEQ ID NO: 1334 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is methioninesulfone
  MOD_RES (23)..(23): C-terminal amidation
SYYKWHCAXRDLKGTFTCVWVKF

SEQ ID NO: 1335 - protein, 23 aa, Artificial Sequence
  Synthetic peptide
  MOD_RES (1)..(1): N-terminal acetylation
  MISC_FEATURE (7)..(18): Cys linked via disulfide bond
  MOD_RES (9)..(9): Xaa is methioninesulfone
  MOD_RES (16)..(16): Xaa is norleucine
  MOD_RES (23)..(23): C-terminal amidation
SYYKWHCAXRDLKGTXTCVWVKF

SEQ ID NO: 1336 - protein, 22 aa, Artificial Sequence
  Synthetic peptide
  MOD_RES (1)..(1): N-terminal alkylation
  MOD_RES (1)..(1): 2kDa PEG
  MISC_FEATURE (6)..(17): Cys is linked via disulfide bond
  MOD_RES (22)..(22): C-terminal amidation
YYKWHCAMRDMKGTMTCVWVKF

SEQ ID NO: 1337 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (9)..(9): Xaa is Selenomethionine
  MOD_RES (12)..(12): Xaa is Selenomethionine
  MOD_RES (16)..(16): Xaa is Selenomethionine
  MOD_RES (23)..(23): C-terminal amidation
SRYKWFCGXRDXKGTXSCVWVKF

SEQ ID NO: 1338 - protein, 23 aa, Artificial Sequence
  Synthetic peptide
  MOD_RES (1)..(1): N-terminal aminooxyacetic acid (AOA)
  DISULFID (7)..(18): Cys residues linked via disulfide bond
  MOD_RES (23)..(23): C-terminal amidation
SRYKWFCGMRDMKGTMSCVWVKF

SEQ ID NO: 1339 - protein, 24 aa, Artificial Sequence
  Synthetic peptide
  MOD_RES (1)..(1): N-terminal acetylation
  DISULFID (7)..(18): Cys residues linked via disulfide bond
  MOD_RES (24)..(24): Xaa is 1-Amino-(4-methoximino)-cyclohexane-1-carboxlic acid (Con(Meox))
  MOD_RES (24)..(24): C-terminal amidation
SYYKWHCAMRDMKGTMTCVWVKFX

SEQ ID NO: 1340 - protein, 23 aa, Artificial Sequence
  Synthetic peptide
  MOD_RES (1)..(1): N-terminal acetylation
  DISULFID (7)..(18): Cys residues linked vis disulfide bond
  MOD_RES (23)..(23): Xaa is 1-Amino-(4-methoximino)-cyclohexane-1-carboxlic acid (Con(Meox))
  MOD_RES (23)..(23): C-terminal amidation
SYYKWHCAMRDMKGTMTCVWVKX

SEQ ID NO: 1341 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): Xaa is 1-Amino-(4-methoximino)-cyclohexane-1-carboxlic acid (Con(Meox))
  MOD_RES (23)..(23): C-terminal amidation
SYYKWHCAMRDMXGTMTCVWVKF

SEQ ID NO: 1342 - protein, 23 aa, Artificial Sequence
  Synthetic peptide
  MOD_RES (1)..(1): N-terminal ethylidene-aminooxy-acetic acid (Oxme-AOA)
  DISULFID (7)..(18): Cys residues linked vis disulfide bond
  MOD_RES (23)..(23): C-terminal amidation
SYYKWHCAMRDMKGTMTCVWVKF

SEQ ID NO: 1343 - protein, 22 aa, Artificial Sequence
  Synthetic peptide
  MOD_RES (1)..(1): N-terminal ethylidene-aminooxy-acetic acid (Oxme-AOA)
  DISULFID (6)..(17): Cys residues linked via disulfide bond
  MOD_RES (22)..(22): C-terminal amidation
YYKWHCAMRDMKGTMTCVWVKF

SEQ ID NO: 1344 - protein, 21 aa, Artificial Sequence
  Synthetic peptide
  MOD_RES (1)..(1): N-terminal ethylidene-aminooxy-acetic acid (Oxme-AOA)
  DISULFID (5)..(16): Cys residues linked via disulfide bond
  MOD_RES (21)..(21): C-terminal amidation
YKWHCAMRDMKGTMTCVWVKF

SEQ ID NO: 1345 - protein, 23 aa, Artificial Sequence
  Synthetic peptide
  MOD_RES (1)..(1): N-terminal 4-methoxyimino-pentanoic acid (Meox-Lev)
  DISULFID (7)..(18): Cys residues linked via disulfide bond
  MOD_RES (23)..(23): C-terminal amidation
SYYKWHCAMRDMKGTMTCVWVKF

SEQ ID NO: 1346 - protein, 22 aa, Artificial Sequence
  Synthetic peptide
  MOD_RES (1)..(1): N-terminal 4-methoxyimino-pentanoic acid (Meox-Lev)
  DISULFID (6)..(17): Cys residues linked via disulfide bond
  MOD_RES (22)..(22): C-terminal amidation
YYKWHCAMRDMKGTMTCVWVKF

SEQ ID NO: 1347 - protein, 21 aa, Artificial Sequence
  Synthetic peptide
  MOD_RES (1)..(1): N-terminal 4-methoxyimino-pentanoic acid (Meox-Lev)
  DISULFID (5)..(16): Cys residues linked via disulfide bond
  MOD_RES (21)..(21): C-terminal amidation
YKWHCAMRDMKGTMTCVWVKF

SEQ ID NO: 1348 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): N-ethylmaleiimido Cys
  MOD_RES (23)..(23): C-terminal amidation
SYYKWHCAMRDMCGTMTCVWVKF

SEQ ID NO: 1349 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): N-ethylmaleiimido Cys
  MOD_RES (23)..(23): C-terminal amidation
SYYKWHCAMRDMKGTMTCVWVKC

SEQ ID NO: 1350 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (13)..(13): Xaa is 2-propargylglycine (Eag)
  MOD_RES (23)..(23): C-terminal amidation
SYYKWHCAMRDMXGTMTCVWVKF

SEQ ID NO: 1351 - protein, 24 aa, Artificial Sequence
  Synthetic peptide
  MOD_RES (1)..(1): N-terminal acetylation
  DISULFID (7)..(18): Cys residues linked via disulfide bond
  MOD_RES (24)..(24): Xaa is 2-propargylglycine (Eag)
  MOD_RES (24)..(24): C-terminal amidation
SYYKWHCAMRDMKGTMTCVWVKFX

SEQ ID NO: 1352 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (23)..(23): Xaa is 2-propargylglycine (Eag)
  MOD_RES (23)..(23): C-terminal amidation
SYYKWHCAMRDMKGTMTCVWVKX

SEQ ID NO: 1353 - protein, 24 aa, Artificial Sequence
  Synthetic peptide
  MOD_RES (1)..(1): N-terminal Carboxyfluorescein
  MOD_RES (1)..(1): Xaa is (13-Amino-4,7,10-trioxa-tridecayl)-succinamic acid (Ttds)
  DISULFID (8)..(19): Cys residues linked via disulfide bond
  MOD_RES (24)..(24): C-terminal amidation
XSYYKWHCAMRDMKGTMTCVWVKF

SEQ ID NO: 1354 - protein, 24 aa, Artificial Sequence
  Synthetic peptide
  MOD_RES (1)..(1): N-terminal Carboxyfluorescein
  MOD_RES (1)..(1): Xaa is (13-Amino-4,7,10-trioxa-tridecayl)-succinamic acid (Ttds)
  DISULFID (8)..(19): Cys residues linked via disulfide bond
  MOD_RES (24)..(24): C-terminal amidation
XASMTKFCKWVMKTYRMYCHGVDW

SEQ ID NO: 1355 - protein, 23 aa, Artificial Sequence
  Synthetic peptide
  MOD_RES (1)..(1): N-terminal acetylation
  DISULFID (7)..(18): Cys residues linked via disulfide bond
  MOD_RES (12)..(12): Xaa is L-selenomethionine
  MOD_RES (16)..(16): Xaa is L-selenomethionine
  MOD_RES (23)..(23): C-terminal amidation
SYYKWHCAMRDXKGTXTCVWVKF

SEQ ID NO: 1356-2000 - skipped (645 entries)

SEQ ID NO: 2001 - protein, 31 aa, Artificial Sequence
  Synthetic peptide
  MOD_RES (1)..(1): N-terminal acetylation
  MOD_RES (31)..(31): C-terminal amidation
SGYASFALAVQLHVSKRSKEMALARLYYKTS

SEQ ID NO: 2002 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYKTS

SEQ ID NO: 2003 - protein, 35 aa, Artificial Sequence
  Synthetic peptide
  MOD_RES (1)..(1): N-terminal acetylation
  MOD_RES (35)..(35): C-terminal amidation
KKSGYASFPLAVQLHVSKRSKEMALARLYYKTSKK

SEQ ID NO: 2004 - protein, 31 aa, Artificial Sequence
  Synthetic peptide
  MOD_RES (1)..(1): N-terminal acetylation
  MOD_RES (31)..(31): C-terminal amidation
AGYASFPLAVQLHVSKRSKEMALARLYYKTS

SEQ ID NO: 2005 - protein, 31 aa, Artificial Sequence
  Synthetic peptide
  MOD_RES (1)..(1): N-terminal acetylation
  MOD_RES (31)..(31): C-terminal amidation
SAYASFPLAVQLHVSKRSKEMALARLYYKTS

SEQ ID NO: 2006 - protein, 31 aa, Artificial Sequence
  Synthetic peptide
  MOD_RES (1)..(1): N-terminal acetylation
  MOD_RES (31)..(31): C-terminal amidation
SGYAAFPLAVQLHVSKRSKEMALARLYYKTS

SEQ ID NO: 2007 - protein, 31 aa, Artificial Sequence
  Synthetic peptide
  MOD_RES (1)..(1): N-terminal acetylation
  MOD_RES (31)..(31): C-terminal amidation
SGYASFPLAVALHVSKRSKEMALARLYYKTS

SEQ ID NO: 2008 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVAKRSKEMALARLYYKTS

SEQ ID NO: 2009 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRAKEMALARLYYKTS

SEQ ID NO: 2010 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSAEMALARLYYKTS

SEQ ID NO: 2011 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALAALYYKTS

SEQ ID NO: 2012 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYATS

SEQ ID NO: 2013 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYKAS

SEQ ID NO: 2014 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYYKTA

SEQ ID NO: 2015 - protein, 21 aa, Artificial Sequence
  Synthetic peptide
  MOD_RES (1)..(1): N-terminal acetylation
  MOD_RES (21)..(21): C-terminal amidation
GYASFPLAVQLHVAKRSKEMA

SEQ ID NO: 2016 - protein, 32 aa, Artificial Sequence
  Synthetic peptide
  MOD_RES (1)..(1): N-terminal acetylation
  MOD_RES (32)..(32): C-terminal amidation
KKASFPLAVQLHVSKRSKEMALARLYYKTSKK

SEQ ID NO: 2017 - protein, 25 aa, Artificial Sequence
  Synthetic peptide
  MOD_RES (1)..(1): N-terminal acetylation
  MOD_RES (25)..(25): C-terminal amidation
ASFPLAVQLHVSKRSKEMALARLYY

SEQ ID NO: 2018 - protein, 31 aa, Artificial Sequence
  Synthetic peptide
  MOD_RES (1)..(1): N-terminal acetylation
  MOD_RES (31)..(31): C-terminal amidation
SGYASFPAAVQLHVSKRSKEMALARLYYKTS

SEQ ID NO: 2019 - protein, 31 aa, Artificial Sequence
  Synthetic peptide
  MOD_RES (1)..(1): N-terminal acetylation
  MOD_RES (31)..(31): C-terminal amidation
SGYASFPLAVQAHVSKRSKEMALARLYYKTS

SEQ ID NO: 2020 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKAMALARLYYKTS

SEQ ID NO: 2021 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARAYYKTS

SEQ ID NO: 2022 - protein, 21 aa, Artificial Sequence
  Synthetic peptide
  MOD_RES (1)..(1): N-terminal acetylation
  MOD_RES (21)..(21): C-terminal amidation
GYASFPLAVQLHVMKRSKEMA

SEQ ID NO: 2023 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMA

SEQ ID NO: 2024 - protein, 21 aa, Artificial Sequence
  Synthetic peptide
  MOD_RES (1)..(1): N-terminal acetylation
  MOD_RES (21)..(21): C-terminal amidation
AYASFPWFVQLHVHKRSWEMA

SEQ ID NO: 2025 - protein, 21 aa, Artificial Sequence
  Synthetic peptide
  MOD_RES (1)..(1): N-terminal acetylation
  MOD_RES (21)..(21): C-terminal amidation
GYAAFPWFVQLHVHKRSWEMA

SEQ ID NO: 2026 - protein, 21 aa, Artificial Sequence
  Synthetic peptide
  MOD_RES (1)..(1): N-terminal acetylation
  MOD_RES (21)..(21): C-terminal amidation
GYASFPWAVQLHVHKRSWEMA

SEQ ID NO: 2027 - protein, 21 aa, Artificial Sequence
  Synthetic peptide
  MOD_RES (1)..(1): N-terminal acetylation
  MOD_RES (21)..(21): C-terminal amidation
GYASFPWFVALHVHKRSWEMA

SEQ ID NO: 2028 - protein, 21 aa, Artificial Sequence
  Synthetic peptide
  MOD_RES (1)..(1): N-terminal acetylation
  MOD_RES (21)..(21): C-terminal amidation
CYASFPWFVQLHVHKRSWEMA

SEQ ID NO: 2029 - protein, 21 aa, Artificial Sequence
  Synthetic peptide
  MOD_RES (1)..(1): N-terminal acetylation
  MOD_RES (21)..(21): C-terminal amidation
GCASFPWFVQLHVHKRSWEMA

SEQ ID NO: 2030 - protein, 21 aa, Artificial Sequence
  Synthetic peptide
  MOD_RES (1)..(1): N-terminal acetylation
  MOD_RES (21)..(21): C-terminal amidation
GYCSFPWFVQLHVHKRSWEMA

SEQ ID NO: 2031 - protein, 21 aa, Artificial Sequence
  Synthetic peptide
  MOD_RES (1)..(1): N-terminal acetylation
  MOD_RES (21)..(21): C-terminal amidation
GYACFPWFVQLHVHKRSWEMA

SEQ ID NO: 2032 - protein, 21 aa, Artificial Sequence
  Synthetic peptide
  MOD_RES (1)..(1): N-terminal acetylation
  MOD_RES (21)..(21): C-terminal amidation
GYASCPWFVQLHVHKRSWEMA

SEQ ID NO: 2033 - protein, 21 aa, Artificial Sequence
  Synthetic peptide
  MOD_RES (1)..(1): N-terminal acetylation
  MOD_RES (21)..(21): C-terminal amidation
GYASFPCFVQLHVHKRSWEMA

SEQ ID NO: 2034 - protein, 21 aa, Artificial Sequence
  Synthetic peptide
  MOD_RES (1)..(1): N-terminal acetylation
  MOD_RES (21)..(21): C-terminal amidation
GYASFPWCVQLHVHKRSWEMA

SEQ ID NO: 2035 - protein, 21 aa, Artificial Sequence
  Synthetic peptide
  MOD_RES (1)..(1): N-terminal acetylation
  MOD_RES (21)..(21): C-terminal amidation
GYASFPWFCQLHVHKRSWEMA

SEQ ID NO: 2036 - protein, 21 aa, Artificial Sequence
  Synthetic peptide
  MOD_RES (1)..(1): N-terminal acetylation
  MOD_RES (21)..(21): C-terminal amidation
GYASFPWFVCLHVHKRSWEMA

SEQ ID NO: 2037 - protein, 21 aa, Artificial Sequence
  Synthetic peptide
  MOD_RES (1)..(1): N-terminal acetylation
  MOD_RES (21)..(21): C-terminal amidation
GYASFPWFVQLHCHKRSWEMA

SEQ ID NO: 2038 - protein, 21 aa, Artificial Sequence
  Synthetic peptide
  MOD_RES (1)..(1): N-terminal acetylation
  MOD_RES (21)..(21): C-terminal amidation
GYASFPWFVQLHVCKRSWEMA

SEQ ID NO: 2039 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRCWEMA

SEQ ID NO: 2040 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSCEMA

SEQ ID NO: 2041 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWCMA

SEQ ID NO: 2042 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWECA

SEQ ID NO: 2043 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMC

SEQ ID NO: 2044 - protein, 21 aa, Artificial Sequence
  Synthetic peptide
  MOD_RES (1)..(1): N-terminal acetylation
  MOD_RES (21)..(21): C-terminal amidation
DYASFPWFVQLHVHKRSWEMA

SEQ ID NO: 2045 - protein, 21 aa, Artificial Sequence
  Synthetic peptide
  MOD_RES (1)..(1): N-terminal acetylation
  MOD_RES (21)..(21): C-terminal amidation
GYASFPWFVQLHVFKRSWEMA

SEQ ID NO: 2046 - protein, 21 aa, Artificial Sequence
  Synthetic peptide
  MOD_RES (1)..(1): N-terminal acetylation
  MOD_RES (21)..(21): C-terminal amidation
GYGSFPWFVQLHVHKRSWEMA

SEQ ID NO: 2047 - protein, 21 aa, Artificial Sequence
  Synthetic peptide
  MOD_RES (1)..(1): N-terminal acetylation
  MOD_RES (21)..(21): C-terminal amidation
GYAGFPWFVQLHVHKRSWEMA

SEQ ID NO: 2048 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRGWEMA

SEQ ID NO: 2049 - protein, 21 aa, Artificial Sequence
  Synthetic peptide
  MOD_RES (1)..(1): N-terminal acetylation
  MOD_RES (21)..(21): C-terminal amidation
GYHSFPWFVQLHVHKRSWEMA

SEQ ID NO: 2050 - protein, 21 aa, Artificial Sequence
  Synthetic peptide
  MOD_RES (1)..(1): N-terminal acetylation
  MOD_RES (21)..(21): C-terminal amidation
GYAHFPWFVQLHVHKRSWEMA

SEQ ID NO: 2051 - protein, 21 aa, Artificial Sequence
  Synthetic peptide
  MOD_RES (1)..(1): N-terminal acetylation
  MOD_RES (21)..(21): C-terminal amidation
GYASHPWFVQLHVHKRSWEMA

SEQ ID NO: 2052 - protein, 21 aa, Artificial Sequence
  Synthetic peptide
  MOD_RES (1)..(1): N-terminal acetylation
  MOD_RES (21)..(21): C-terminal amidation
GYASFPWHVQLHVHKRSWEMA

SEQ ID NO: 2053 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWHMA

SEQ ID NO: 2054 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMH

SEQ ID NO: 2055 - protein, 21 aa, Artificial Sequence
  Synthetic peptide
  MOD_RES (1)..(1): N-terminal acetylation
  MOD_RES (21)..(21): C-terminal amidation
GYISFPWFVQLHVHKRSWEMA

SEQ ID NO: 2056 - protein, 21 aa, Artificial Sequence
  Synthetic peptide
  MOD_RES (1)..(1): N-terminal acetylation
  MOD_RES (21)..(21): C-terminal amidation
GYAIFPWFVQLHVHKRSWEMA

SEQ ID NO: 2057 - protein, 21 aa, Artificial Sequence
  Synthetic peptide
  MOD_RES (1)..(1): N-terminal acetylation
  MOD_RES (21)..(21): C-terminal amidation
GYASFPWFVQIHVHKRSWEMA

SEQ ID NO: 2058 - protein, 21 aa, Artificial Sequence
  Synthetic peptide
  MOD_RES (1)..(1): N-terminal acetylation
  MOD_RES (21)..(21): C-terminal amidation
GYASFPWFVQLHVIKRSWEMA

SEQ ID NO: 2059 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRIWEMA

SEQ ID NO: 2060 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSIEMA

SEQ ID NO: 2061 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMI

SEQ ID NO: 2062 - protein, 21 aa, Artificial Sequence
  Synthetic peptide
  MOD_RES (1)..(1): N-terminal acetylation
  MOD_RES (21)..(21): C-terminal amidation
KYASFPWFVQLHVHKRSWEMA

SEQ ID NO: 2063 - protein, 21 aa, Artificial Sequence
  Synthetic peptide
  MOD_RES (1)..(1): N-terminal acetylation
  MOD_RES (21)..(21): C-terminal amidation
GKASFPWFVQLHVHKRSWEMA

SEQ ID NO: 2064 - protein, 21 aa, Artificial Sequence
  Synthetic peptide
  MOD_RES (1)..(1): N-terminal acetylation
  MOD_RES (21)..(21): C-terminal amidation
GYKSFPWFVQLHVHKRSWEMA

SEQ ID NO: 2065 - protein, 21 aa, Artificial Sequence
  Synthetic peptide
  MOD_RES (1)..(1): N-terminal acetylation
  MOD_RES (21)..(21): C-terminal amidation
GYAKFPWFVQLHVHKRSWEMA

SEQ ID NO: 2066 - protein, 21 aa, Artificial Sequence
  Synthetic peptide
  MOD_RES (1)..(1): N-terminal acetylation
  MOD_RES (21)..(21): C-terminal amidation
GYASKPWFVQLHVHKRSWEMA

SEQ ID NO: 2067 - protein, 21 aa, Artificial Sequence
  Synthetic peptide
  MOD_RES (1)..(1): N-terminal acetylation
  MOD_RES (21)..(21): C-terminal amidation
GYASFPWKVQLHVHKRSWEMA

SEQ ID NO: 2068 - protein, 21 aa, Artificial Sequence
  Synthetic peptide
  MOD_RES (1)..(1): N-terminal acetylation
  MOD_RES (21)..(21): C-terminal amidation
GYASFPWFVKLHVHKRSWEMA

SEQ ID NO: 2069 - protein, 21 aa, Artificial Sequence
  Synthetic peptide
  MOD_RES (1)..(1): N-terminal acetylation
  MOD_RES (21)..(21): C-terminal amidation
GYASFPWFVQKHVHKRSWEMA

SEQ ID NO: 2070 - protein, 21 aa, Artificial Sequence
  Synthetic peptide
  MOD_RES (1)..(1): N-terminal acetylation
  MOD_RES (21)..(21): C-terminal amidation
GYASFPWFVQLHKHKRSWEMA

SEQ ID NO: 2071 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRKWEMA

SEQ ID NO: 2072 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWKMA

SEQ ID NO: 2073 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMK

SEQ ID NO: 2074 - protein, 21 aa, Artificial Sequence
  Synthetic peptide
  MOD_RES (1)..(1): N-terminal acetylation
  MOD_RES (21)..(21): C-terminal amidation
LYASFPWFVQLHVHKRSWEMA

SEQ ID NO: 2075 - protein, 21 aa, Artificial Sequence
  Synthetic peptide
  MOD_RES (1)..(1): N-terminal acetylation
  MOD_RES (21)..(21): C-terminal amidation
GYLSFPWFVQLHVHKRSWEMA

SEQ ID NO: 2076 - protein, 21 aa, Artificial Sequence
  Synthetic peptide
  MOD_RES (1)..(1): N-terminal acetylation
  MOD_RES (21)..(21): C-terminal amidation
GYALFPWFVQLHVHKRSWEMA

SEQ ID NO: 2077 - protein, 21 aa, Artificial Sequence
  Synthetic peptide
  MOD_RES (1)..(1): N-terminal acetylation
  MOD_RES (21)..(21): C-terminal amidation
GYASFPWFVLLHVHKRSWEMA

SEQ ID NO: 2078 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRLWEMA

SEQ ID NO: 2079 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEML

SEQ ID NO: 2080 - protein, 21 aa, Artificial Sequence
  Synthetic peptide
  MOD_RES (1)..(1): N-terminal acetylation
  MOD_RES (21)..(21): C-terminal amidation
MYASFPWFVQLHVHKRSWEMA

SEQ ID NO: 2081 - protein, 21 aa, Artificial Sequence
  Synthetic peptide
  MOD_RES (1)..(1): N-terminal acetylation
  MOD_RES (21)..(21): C-terminal amidation
GYMSFPWFVQLHVHKRSWEMA

SEQ ID NO: 2082 - protein, 21 aa, Artificial Sequence
  Synthetic peptide
  MOD_RES (1)..(1): N-terminal acetylation
  MOD_RES (21)..(21): C-terminal amidation
GYAMFPWFVQLHVHKRSWEMA

SEQ ID NO: 2083 - protein, 21 aa, Artificial Sequence
  Synthetic peptide
  MOD_RES (1)..(1): N-terminal acetylation
  MOD_RES (21)..(21): C-terminal amidation
GYASFPWFVQMHVHKRSWEMA

SEQ ID NO: 2084 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMM

SEQ ID NO: 2085 - protein, 21 aa, Artificial Sequence
  Synthetic peptide
  MOD_RES (1)..(1): N-terminal acetylation
  MOD_RES (21)..(21): C-terminal amidation
NYASFPWFVQLHVHKRSWEMA

SEQ ID NO: 2086 - protein, 21 aa, Artificial Sequence
  Synthetic peptide
  MOD_RES (1)..(1): N-terminal acetylation
  MOD_RES (21)..(21): C-terminal amidation
GYANFPWFVQLHVHKRSWEMA

SEQ ID NO: 2087 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRNWEMA

SEQ ID NO: 2088 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMN

SEQ ID NO: 2089 - protein, 21 aa, Artificial Sequence
  Synthetic peptide
  MOD_RES (1)..(1): N-terminal acetylation
  MOD_RES (21)..(21): C-terminal amidation
PYASFPWFVQLHVHKRSWEMA

SEQ ID NO: 2090 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRQWEMA

SEQ ID NO: 2091 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMQ

SEQ ID NO: 2092 - protein, 21 aa, Artificial Sequence
  Synthetic peptide
  MOD_RES (1)..(1): N-terminal acetylation
  MOD_RES (21)..(21): C-terminal amidation
RYASFPWFVQLHVHKRSWEMA

SEQ ID NO: 2093 - protein, 21 aa, Artificial Sequence
  Synthetic peptide
  MOD_RES (1)..(1): N-terminal acetylation
  MOD_RES (21)..(21): C-terminal amidation
GRASFPWFVQLHVHKRSWEMA

SEQ ID NO: 2094 - protein, 21 aa, Artificial Sequence
  Synthetic peptide
  MOD_RES (1)..(1): N-terminal acetylation
  MOD_RES (21)..(21): C-terminal amidation
GYRSFPWFVQLHVHKRSWEMA

SEQ ID NO: 2095 - protein, 21 aa, Artificial Sequence
  Synthetic peptide
  MOD_RES (1)..(1): N-terminal acetylation
  MOD_RES (21)..(21): C-terminal amidation
GYARFPWFVQLHVHKRSWEMA

SEQ ID NO: 2096 - protein, 21 aa, Artificial Sequence
  Synthetic peptide
  MOD_RES (1)..(1): N-terminal acetylation
  MOD_RES (21)..(21): C-terminal amidation
GYASRPWFVQLHVHKRSWEMA

SEQ ID NO: 2097 - protein, 21 aa, Artificial Sequence
  Synthetic peptide
  MOD_RES (1)..(1): N-terminal acetylation
  MOD_RES (21)..(21): C-terminal amidation
GYASFPRFVQLHVHKRSWEMA

SEQ ID NO: 2098 - protein, 21 aa, Artificial Sequence
  Synthetic peptide
  MOD_RES (1)..(1): N-terminal acetylation
  MOD_RES (21)..(21): C-terminal amidation
GYASFPWRVQLHVHKRSWEMA

SEQ ID NO: 2099 - protein, 21 aa, Artificial Sequence
  Synthetic peptide
  MOD_RES (1)..(1): N-terminal acetylation
  MOD_RES (21)..(21): C-terminal amidation
GYASFPWFRQLHVHKRSWEMA

SEQ ID NO: 2100 - protein, 21 aa, Artificial Sequence
  Synthetic peptide
  MOD_RES (1)..(1): N-terminal acetylation
  MOD_RES (21)..(21): C-terminal amidation
GYASFPWFVRLHVHKRSWEMA

SEQ ID NO: 2101 - protein, 21 aa, Artificial Sequence
  Synthetic peptide
  MOD_RES (1)..(1): N-terminal acetylation
  MOD_RES (21)..(21): C-terminal amidation
GYASFPWFVQRHVHKRSWEMA

SEQ ID NO: 2102 - protein, 21 aa, Artificial Sequence
  Synthetic peptide
  MOD_RES (1)..(1): N-terminal acetylation
  MOD_RES (21)..(21): C-terminal amidation
GYASFPWFVQLHRHKRSWEMA

SEQ ID NO: 2103 - protein, 21 aa, Artificial Sequence
  Synthetic peptide
  MOD_RES (1)..(1): N-terminal acetylation
  MOD_RES (21)..(21): C-terminal amidation
GYASFPWFVQLHVRKRSWEMA

SEQ ID NO: 2104 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHRRSWEMA

SEQ ID NO: 2105 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRRWEMA

SEQ ID NO: 2106 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSREMA

SEQ ID NO: 2107 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWRMA

SEQ ID NO: 2108 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMR

SEQ ID NO: 2109 - protein, 21 aa, Artificial Sequence
  Synthetic peptide
  MOD_RES (1)..(1): N-terminal acetylation
  MOD_RES (21)..(21): C-terminal amidation
SYASFPWFVQLHVHKRSWEMA

SEQ ID NO: 2110 - protein, 21 aa, Artificial Sequence
  Synthetic peptide
  MOD_RES (1)..(1): N-terminal acetylation
  MOD_RES (21)..(21): C-terminal amidation
GYSSFPWFVQLHVHKRSWEMA

SEQ ID NO: 2111 - protein, 21 aa, Artificial Sequence
  Synthetic peptide
  MOD_RES (1)..(1): N-terminal acetylation
  MOD_RES (21)..(21): C-terminal amidation
GYASFPWFVSLHVHKRSWEMA

SEQ ID NO: 2112 - protein, 21 aa, Artificial Sequence
  Synthetic peptide
  MOD_RES (1)..(1): N-terminal acetylation
  MOD_RES (21)..(21): C-terminal amidation
TYASFPWFVQLHVHKRSWEMA

SEQ ID NO: 2113 - protein, 21 aa, Artificial Sequence
  Synthetic peptide
  MOD_RES (1)..(1): N-terminal acetylation
  MOD_RES (21)..(21): C-terminal amidation
GYTSFPWFVQLHVHKRSWEMA

SEQ ID NO: 2114 - protein, 21 aa, Artificial Sequence
  Synthetic peptide
  MOD_RES (1)..(1): N-terminal acetylation
  MOD_RES (21)..(21): C-terminal amidation
GYATFPWFVQLHVHKRSWEMA

SEQ ID NO: 2115 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRTWEMA

SEQ ID NO: 2116 - protein, 21 aa, Artificial Sequence
  Synthetic peptide
  MOD_RES (1)..(1): N-terminal acetylation
  MOD_RES (21)..(21): C-terminal amidation
GYASFPWVVQLHVHKRSWEMA

SEQ ID NO: 2117 - protein, 21 aa, Artificial Sequence
  Synthetic peptide
  MOD_RES (1)..(1): N-terminal acetylation
  MOD_RES (21)..(21): C-terminal amidation
GYASFPWFVQVHVHKRSWEMA

SEQ ID NO: 2118 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRVWEMA

SEQ ID NO: 2119 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMV

SEQ ID NO: 2120 - protein, 21 aa, Artificial Sequence
  Synthetic peptide
  MOD_RES (1)..(1): N-terminal acetylation
  MOD_RES (21)..(21): C-terminal amidation
GWASFPWFVQLHVHKRSWEMA

SEQ ID NO: 2121 - protein, 21 aa, Artificial Sequence
  Synthetic peptide
  MOD_RES (1)..(1): N-terminal acetylation
  MOD_RES (21)..(21): C-terminal amidation
GYWSFPWFVQLHVHKRSWEMA

SEQ ID NO: 2122 - protein, 21 aa, Artificial Sequence
  Synthetic peptide
  MOD_RES (1)..(1): N-terminal acetylation
  MOD_RES (21)..(21): C-terminal amidation
GYASWPWFVQLHVHKRSWEMA

SEQ ID NO: 2123 - protein, 21 aa, Artificial Sequence
  Synthetic peptide
  MOD_RES (1)..(1): N-terminal acetylation
  MOD_RES (21)..(21): C-terminal amidation
GYASFPWWVQLHVHKRSWEMA

SEQ ID NO: 2124 - protein, 21 aa, Artificial Sequence
  Synthetic peptide
  MOD_RES (1)..(1): N-terminal acetylation
  MOD_RES (21)..(21): C-terminal amidation
GYASFPWFVQWHVHKRSWEMA

SEQ ID NO: 2125 - protein, 21 aa, Artificial Sequence
  Synthetic peptide
  MOD_RES (1)..(1): N-terminal acetylation
  MOD_RES (20)..(20): C-terminal amidation
GYASFPWFVQLHVHKRSWEMW

SEQ ID NO: 2126 - protein, 21 aa, Artificial Sequence
  Synthetic peptide
  MOD_RES (1)..(1): N-terminal acetylation
  MOD_RES (21)..(21): C-terminal amidation
GYASFPWYVQLHVHKRSWEMA

SEQ ID NO: 2127 - protein, 30 aa, Artificial Sequence
  Synthetic peptide
  MOD_RES (1)..(1): N-terminal acetylation
  MOD_RES (30)..(30): C-terminal amidation
MKSRSLGLAYFAKHSSLEVLQTRKVAAPYY

SEQ ID NO: 2128 - protein, 29 aa, Artificial Sequence
  Synthetic peptide
  MOD_RES (1)..(1): N-terminal acetylation
  MOD_RES (29)..(29): C-terminal amidation
KKSGYASFPLAVQLHVSKRSKEMALARKK

SEQ ID NO: 2129 - protein, 29 aa, Artificial Sequence
  Synthetic peptide
  MOD_RES (1)..(1): N-terminal acetylation
  MOD_RES (29)..(29): C-terminal amidation
KKPLAVQLHVSKRSKEMALARLYYKTSKK

SEQ ID NO: 2130 - protein, 24 aa, Artificial Sequence
  Synthetic peptide
  MOD_RES (1)..(1): N-terminal acetylation
  MOD_RES (24)..(24): C-terminal amidation
ASFPLAVQLHVSKRSKEMALARLY

SEQ ID NO: 2131 - protein, 31 aa, Artificial Sequence
  Synthetic peptide
  MOD_RES (1)..(1): N-terminal acetylation
  MOD_RES (31)..(31): C-terminal amidation
SGAASFPLAVQLHVSKRSKEMALARLYYKTS

SEQ ID NO: 2132 - protein, 31 aa, Artificial Sequence
  Synthetic peptide
  MOD_RES (1)..(1): N-terminal acetylation
  MOD_RES (31)..(31): C-terminal amidation
SGYASAPLAVQLHVSKRSKEMALARLYYKTS

SEQ ID NO: 2133 - protein, 31 aa, Artificial Sequence
  Synthetic peptide
  MOD_RES (1)..(1): N-terminal acetylation
  MOD_RES (31)..(31): C-terminal amidation
SGYASFPLAAQLHVSKRSKEMALARLYYKTS

SEQ ID NO: 2134 - protein, 31 aa, Artificial Sequence
  Synthetic peptide
  MOD_RES (1)..(1): N-terminal acetylation
  MOD_RES (31)..(31): C-terminal amidation
SGYASFPLAVQLAVSKRSKEMALARLYYKTS

SEQ ID NO: 2135 - protein, 31 aa, Artificial Sequence
  Synthetic peptide
  MOD_RES (1)..(1): N-terminal acetylation
  MOD_RES (31)..(31): C-terminal amidation
SGYASFPLAVQLHASKRSKEMALARLYYKTS

SEQ ID NO: 2136 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSARSKEMALARLYYKTS

SEQ ID NO: 2137 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKASKEMALARLYYKTS

SEQ ID NO: 2138 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEAALARLYYKTS

SEQ ID NO: 2139 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMAAARLYYKTS

SEQ ID NO: 2140 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLAYKTS

SEQ ID NO: 2141 - protein, 31 aa, Artificial Sequence
  Synthetic peptide
  MOD_RES (1)..(1): N-terminal acetylation
  MOD_RES (31)..(31): C-terminal amidation
SGYASFPLAVQLHVSKRSKEMALARLYAKTS

SEQ ID NO: 2142 - protein, 33 aa, Artificial Sequence
  Synthetic peptide
GSSGYASFPLAVQLHVSKRSKEMALARLYYKTS

SEQ ID NO: 2143 - protein, 21 aa, Artificial Sequence
  Synthetic peptide
  MOD_RES (1)..(1): N-terminal acetylation
  MOD_RES (21)..(21): C-terminal amidation
GYWSFPHAVWHHVSKRSKEMA

SEQ ID NO: 2144 - protein, 21 aa, Artificial Sequence
  Synthetic peptide
  MOD_RES (1)..(1): N-terminal acetylation
  MOD_RES (21)..(21): C-terminal amidation
GYASFWQAVQLHVWKRSKEIA

SEQ ID NO: 2145 - protein, 21 aa, Artificial Sequence
  Synthetic peptide
  MOD_RES (1)..(1): N-terminal acetylation
  MOD_RES (21)..(21): C-terminal amidation
GYASFPLIVWLHVSKRSKEMA

SEQ ID NO: 2146 - protein, 21 aa, Artificial Sequence
  Synthetic peptide
  MOD_RES (1)..(1): N-terminal acetylation
  MOD_RES (21)..(21): C-terminal amidation
GYASFWQAVQLHVSKRSKEIA

SEQ ID NO: 2147 - protein, 21 aa, Artificial Sequence
  Synthetic peptide
  MOD_RES (1)..(1): N-terminal acetylation
  MOD_RES (21)..(21): C-terminal amidation
GYASFPAFVQLHVHKRSWEMA

SEQ ID NO: 2148 - protein, 21 aa, Artificial Sequence
  Synthetic peptide
  MOD_RES (1)..(1): N-terminal acetylation
  MOD_RES (21)..(21): C-terminal amidation
GYASFPWFVQAHVHKRSWEMA

SEQ ID NO: 2149 - protein, 21 aa, Artificial Sequence
  Synthetic peptide
  MOD_RES (1)..(1): N-terminal acetylation
  MOD_RES (21)..(21): C-terminal amidation
GYASFPWFVQLHAHKRSWEMA

SEQ ID NO: 2150 - protein, 21 aa, Artificial Sequence
  Synthetic peptide
  MOD_RES (1)..(1): N-terminal acetylation
  MOD_RES (21)..(21): C-terminal amidation
GYASFPWFVQLHVAKRSWEMA

SEQ ID NO: 2151 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWAMA

SEQ ID NO: 2152 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEAA

SEQ ID NO: 2153 - protein, 21 aa, Artificial Sequence
  Synthetic peptide
  MOD_RES (1)..(1): N-terminal acetylation
  MOD_RES (21)..(21): C-terminal amidation
GYASFCWFVQLHVHKRSWEMA

SEQ ID NO: 2154 - protein, 21 aa, Artificial Sequence
  Synthetic peptide
  MOD_RES (1)..(1): N-terminal acetylation
  MOD_RES (21)..(21): C-terminal amidation
GYASFPWFVQLCVHKRSWEMA

SEQ ID NO: 2155 - protein, 21 aa, Artificial Sequence
  Synthetic peptide
  MOD_RES (1)..(1): N-terminal acetylation
  MOD_RES (21)..(21): C-terminal amidation
GDASFPWFVQLHVHKRSWEMA

SEQ ID NO: 2156 - protein, 21 aa, Artificial Sequence
  Synthetic peptide
  MOD_RES (1)..(1): N-terminal acetylation
  MOD_RES (21)..(21): C-terminal amidation
GYDSFPWFVQLHVHKRSWEMA

SEQ ID NO: 2157 - protein, 21 aa, Artificial Sequence
  Synthetic peptide
  MOD_RES (1)..(1): N-terminal acetylation
  MOD_RES (21)..(21): C-terminal amidation
GYADFPWFVQLHVHKRSWEMA

SEQ ID NO: 2158 - protein, 21 aa, Artificial Sequence
  Synthetic peptide
  MOD_RES (1)..(1): N-terminal acetylation
  MOD_RES (21)..(21): C-terminal amidation
GYASDPWFVQLHVHKRSWEMA

SEQ ID NO: 2159 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWDMA

SEQ ID NO: 2160 - protein, 21 aa, Artificial Sequence
  Synthetic peptide
  MOD_RES (1)..(1): N-terminal acetylation
  MOD_RES (21)..(21): C-terminal amidation
GYESFPWFVQLHVHKRSWEMA

SEQ ID NO: 2161 - protein, 21 aa, Artificial Sequence
  Synthetic peptide
  MOD_RES (1)..(1): N-terminal acetylation
  MOD_RES (21)..(21): C-terminal amidation
GYAEFPWFVQLHVHKRSWEMA

SEQ ID NO: 2162 - protein, 21 aa, Artificial Sequence
  Synthetic peptide
  MOD_RES (1)..(1): N-terminal acetylation
  MOD_RES (21)..(21): C-terminal amidation
FYASFPWFVQLHVHKRSWEMA

SEQ ID NO: 2163 - protein, 21 aa, Artificial Sequence
  Synthetic peptide
  MOD_RES (1)..(1): N-terminal acetylation
  MOD_RES (21)..(21): C-terminal amidation
GFASFPWFVQLHVHKRSWEMA

SEQ ID NO: 2164 - protein, 21 aa, Artificial Sequence
  Synthetic peptide
  MOD_RES (1)..(1): N-terminal acetylation
  MOD_RES (21)..(21): C-terminal amidation
GYFSFPWFVQLHVHKRSWEMA

SEQ ID NO: 2165 - protein, 21 aa, Artificial Sequence
  Synthetic peptide
  MOD_RES (1)..(1): N-terminal acetylation
  MOD_RES (21)..(21): C-terminal amidation
GYAFFPWFVQLHVHKRSWEMA

SEQ ID NO: 2166 - protein, 21 aa, Artificial Sequence
  Synthetic peptide
  MOD_RES (1)..(1): N-terminal acetylation
  MOD_RES (21)..(21): C-terminal amidation
GYASFPFFVQLHVHKRSWEMA

SEQ ID NO: 2167 - protein, 21 aa, Artificial Sequence
  Synthetic peptide
  MOD_RES (1)..(1): N-terminal acetylation
  MOD_RES (21)..(21): C-terminal amidation
GYASFPWFFQLHVHKRSWEMA

SEQ ID NO: 2168 - protein, 21 aa, Artificial Sequence
  Synthetic peptide
  MOD_RES (1)..(1): N-terminal acetylation
  MOD_RES (21)..(21): C-terminal amidation
GYASFPWFVFLHVHKRSWEMA

SEQ ID NO: 2169 - protein, 21 aa, Artificial Sequence
  Synthetic peptide
  MOD_RES (1)..(1): N-terminal acetylation
  MOD_RES (21)..(21): C-terminal amidation
GYASFPWFVQLHFHKRSWEMA

SEQ ID NO: 2170 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKFSWEMA

SEQ ID NO: 2171 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRFWEMA

SEQ ID NO: 2172 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSFEMA

SEQ ID NO: 2173 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWFMA

SEQ ID NO: 2174 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEFA

SEQ ID NO: 2175 - protein, 21 aa, Artificial Sequence
  Synthetic peptide
  MOD_RES (1)..(1): N-terminal acetylation
  MOD_RES (21)..(21): C-terminal amidation
GYASGPWFVQLHVHKRSWEMA

SEQ ID NO: 2176 - protein, 21 aa, Artificial Sequence
  Synthetic peptide
  MOD_RES (1)..(1): N-terminal acetylation
  MOD_RES (21)..(21): C-terminal amidation
GYASFPGFVQLHVHKRSWEMA

SEQ ID NO: 2177 - protein, 21 aa, Artificial Sequence
  Synthetic peptide
  MOD_RES (1)..(1): N-terminal acetylation
  MOD_RES (21)..(21): C-terminal amidation
GYASFPWGVQLHVHKRSWEMA

SEQ ID NO: 2178 - protein, 21 aa, Artificial Sequence
  Synthetic peptide
  MOD_RES (1)..(1): N-terminal acetylation
  MOD_RES (21)..(21): C-terminal amidation
GYASFPWFGQLHVHKRSWEMA

SEQ ID NO: 2179 - protein, 21 aa, Artificial Sequence
  Synthetic peptide
  MOD_RES (1)..(1): N-terminal acetylation
  MOD_RES (21)..(21): C-terminal amidation
GYASFPWFVGLHVHKRSWEMA

SEQ ID NO: 2180 - protein, 21 aa, Artificial Sequence
  Synthetic peptide
  MOD_RES (1)..(1): N-terminal acetylation
  MOD_RES (21)..(21): C-terminal amidation
GYASFPWFVQGHVHKRSWEMA

SEQ ID NO: 2181 - protein, 21 aa, Artificial Sequence
  Synthetic peptide
  MOD_RES (1)..(1): N-terminal acetylation
  MOD_RES (21)..(21): C-terminal amidation
GYASFPWFVQLHGHKRSWEMA

SEQ ID NO: 2182 - protein, 21 aa, Artificial Sequence
  Synthetic peptide
  MOD_RES (1)..(1): N-terminal acetylation
  MOD_RES (21)..(21): C-terminal amidation
GYASFPWFVQLHVGKRSWEMA

SEQ ID NO: 2183 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWGMA

SEQ ID NO: 2184 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEGA

SEQ ID NO: 2185 - protein, 21 aa, Artificial Sequence
  Synthetic peptide
  MOD_RES (1)..(1): N-terminal acetylation
  MOD_RES (21)..(21): C-terminal amidation
GHASFPWFVQLHVHKRSWEMA

SEQ ID NO: 2186 - protein, 21 aa, Artificial Sequence
  Synthetic peptide
  MOD_RES (1)..(1): N-terminal acetylation
  MOD_RES (21)..(21): C-terminal amidation
GYASFPHFVQLHVHKRSWEMA

SEQ ID NO: 2187 - protein, 21 aa, Artificial Sequence
  Synthetic peptide
  MOD_RES (1)..(1): N-terminal acetylation
  MOD_RES (21)..(21): C-terminal amidation
GYASFPWFHQLHVHKRSWEMA

SEQ ID NO: 2188 - protein, 21 aa, Artificial Sequence
  Synthetic peptide
  MOD_RES (1)..(1): N-terminal acetylation
  MOD_RES (21)..(21): C-terminal amidation
GYASFPWFVHLHVHKRSWEMA

SEQ ID NO: 2189 - protein, 21 aa, Artificial Sequence
  Synthetic peptide
  MOD_RES (1)..(1): N-terminal acetylation
  MOD_RES (21)..(21): C-terminal amidation
GYASFPWFVQLHHHKRSWEMA

SEQ ID NO: 2190 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEHA

SEQ ID NO: 2191 - protein, 21 aa, Artificial Sequence
  Synthetic peptide
  MOD_RES (1)..(1): N-terminal acetylation
  MOD_RES (21)..(21): C-terminal amidation
IYASFPWFVQLHVHKRSWEMA

SEQ ID NO: 2192 - protein, 21 aa, Artificial Sequence
  Synthetic peptide
  MOD_RES (1)..(1): N-terminal acetylation
  MOD_RES (21)..(21): C-terminal amidation
GYASIPWFVQLHVHKRSWEMA

SEQ ID NO: 2193 - protein, 21 aa, Artificial Sequence
  Synthetic peptide
  MOD_RES (1)..(1): N-terminal acetylation
  MOD_RES (21)..(21): C-terminal amidation
GYASFPIFVQLHVHKRSWEMA

SEQ ID NO: 2194 - protein, 21 aa, Artificial Sequence
  Synthetic peptide
  MOD_RES (1)..(1): N-terminal acetylation
  MOD_RES (21)..(21): C-terminal amidation
GYASFPWFIQLHVHKRSWEMA

SEQ ID NO: 2195 - protein, 21 aa, Artificial Sequence
  Synthetic peptide
  MOD_RES (1)..(1): N-terminal acetylation
  MOD_RES (21)..(21): C-terminal amidation
GYASFPWFVILHVHKRSWEMA

SEQ ID NO: 2196 - protein, 21 aa, Artificial Sequence
  Synthetic peptide
  MOD_RES (1)..(1): N-terminal acetylation
  MOD_RES (21)..(21): C-terminal amidation
GYASFPWFVQLIVHKRSWEMA

SEQ ID NO: 2197 - protein, 21 aa, Artificial Sequence
  Synthetic peptide
  MOD_RES (1)..(1): N-terminal acetylation
  MOD_RES (21)..(21): C-terminal amidation
GYASFKWFVQLHVHKRSWEMA

SEQ ID NO: 2198 - protein, 21 aa, Artificial Sequence
  Synthetic peptide
  MOD_RES (1)..(1): N-terminal acetylation
  MOD_RES (21)..(21): C-terminal amidation
GYASFPKFVQLHVHKRSWEMA

SEQ ID NO: 2199 - protein, 21 aa, Artificial Sequence
  Synthetic peptide
  MOD_RES (1)..(1): N-terminal acetylation
  MOD_RES (21)..(21): C-terminal amidation
GYASFPWFVQLKVHKRSWEMA

SEQ ID NO: 2200 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSKEMA

SEQ ID NO: 2201 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEKA

SEQ ID NO: 2202 - protein, 21 aa, Artificial Sequence
  Synthetic peptide
  MOD_RES (1)..(1): N-terminal acetylation
  MOD_RES (21)..(21): C-terminal amidation
GYASLPWFVQLHVHKRSWEMA

SEQ ID NO: 2203 - protein, 21 aa, Artificial Sequence
  Synthetic peptide
  MOD_RES (1)..(1): N-terminal acetylation
  MOD_RES (21)..(21): C-terminal amidation
GYASFPLFVQLHVHKRSWEMA

SEQ ID NO: 2204 - protein, 21 aa, Artificial Sequence
  Synthetic peptide
  MOD_RES (1)..(1): N-terminal acetylation
  MOD_RES (21)..(21): C-terminal amidation
GYASFPWLVQLHVHKRSWEMA

SEQ ID NO: 2205 - protein, 21 aa, Artificial Sequence
  Synthetic peptide
  MOD_RES (1)..(1): N-terminal acetylation
  MOD_RES (21)..(21): C-terminal amidation
GYASFPWFLQLHVHKRSWEMA

SEQ ID NO: 2206 - protein, 21 aa, Artificial Sequence
  Synthetic peptide
  MOD_RES (1)..(1): N-terminal acetylation
  MOD_RES (21)..(21): C-terminal amidation
GYASFPWFVQLLVHKRSWEMA

SEQ ID NO: 2207 - protein, 21 aa, Artificial Sequence
  Synthetic peptide
  MOD_RES (1)..(1): N-terminal acetylation
  MOD_RES (21)..(21): C-terminal amidation
GYASFPWFVQLHLHKRSWEMA

SEQ ID NO: 2208 - protein, 21 aa, Artificial Sequence
  Synthetic peptide
  MOD_RES (1)..(1): N-terminal acetylation
  MOD_RES (21)..(21): C-terminal amidation
GYASFPWFVQLHVLKRSWEMA

SEQ ID NO: 2209 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSLEMA

SEQ ID NO: 2210 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWLMA

SEQ ID NO: 2211 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWELA

SEQ ID NO: 2212 - protein, 21 aa, Artificial Sequence
  Synthetic peptide
  MOD_RES (1)..(1): N-terminal acetylation
  MOD_RES (21)..(21): C-terminal amidation
GMASFPWFVQLHVHKRSWEMA

SEQ ID NO: 2213 - protein, 21 aa, Artificial Sequence
  Synthetic peptide
  MOD_RES (1)..(1): N-terminal acetylation
  MOD_RES (21)..(21): C-terminal amidation
GYASMPWFVQLHVHKRSWEMA

SEQ ID NO: 2214 - protein, 21 aa, Artificial Sequence
  Synthetic peptide
  MOD_RES (1)..(1): N-terminal acetylation
  MOD_RES (21)..(21): C-terminal amidation
GYASFPWMVQLHVHKRSWEMA

SEQ ID NO: 2215 - protein, 21 aa, Artificial Sequence
  Synthetic peptide
  MOD_RES (1)..(1): N-terminal acetylation
  MOD_RES (21)..(21): C-terminal amidation
GYASFPWFMQLHVHKRSWEMA

SEQ ID NO: 2216 - protein, 21 aa, Artificial Sequence
  Synthetic peptide
  MOD_RES (1)..(1): N-terminal acetylation
  MOD_RES (21)..(21): C-terminal amidation
GYASFPWFVMLHVHKRSWEMA

SEQ ID NO: 2217 - protein, 21 aa, Artificial Sequence
  Synthetic peptide
  MOD_RES (1)..(1): N-terminal acetylation
  MOD_RES (20)..(20): C-terminal amidation
  MOD_RES (21)..(21): C-terminal amidation
GYASFPWFVQLHMHKRSWEMA

SEQ ID NO: 2218 - protein, 21 aa, Artificial Sequence
  Synthetic peptide
  MOD_RES (1)..(1): N-terminal acetylation
  MOD_RES (21)..(21): C-terminal amidation
GYASFPWFVQLHVMKRSWEMA

SEQ ID NO: 2219 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSMEMA

SEQ ID NO: 2220 - protein, 21 aa, Artificial Sequence
  Synthetic peptide
  MOD_RES (1)..(1): N-terminal acetylation
  MOD_RES (21)..(21): C-terminal amidation
GNASFPWFVQLHVHKRSWEMA

SEQ ID NO: 2221 - protein, 21 aa, Artificial Sequence
  Synthetic peptide
  MOD_RES (1)..(1): N-terminal acetylation
  MOD_RES (21)..(21): C-terminal amidation
GYNSFPWFVQLHVHKRSWEMA

SEQ ID NO: 2222 - protein, 21 aa, Artificial Sequence
  Synthetic peptide
  MOD_RES (1)..(1): N-terminal acetylation
  MOD_RES (21)..(21): C-terminal amidation
GYASNPWFVQLHVHKRSWEMA

SEQ ID NO: 2223 - protein, 21 aa, Artificial Sequence
  Synthetic peptide
  MOD_RES (1)..(1): N-terminal acetylation
  MOD_RES (21)..(21): C-terminal amidation
GYASFPNFVQLHVHKRSWEMA

SEQ ID NO: 2224 - protein, 21 aa, Artificial Sequence
  Synthetic peptide
  MOD_RES (1)..(1): N-terminal acetylation
  MOD_RES (21)..(21): C-terminal amidation
GYASFPWNVQLHVHKRSWEMA

SEQ ID NO: 2225 - protein, 21 aa, Artificial Sequence
  Synthetic peptide
  MOD_RES (1)..(1): N-terminal acetylation
  MOD_RES (21)..(21): C-terminal amidation
GYASFPWFVNLHVHKRSWEMA

SEQ ID NO: 2226 - protein, 21 aa, Artificial Sequence
  Synthetic peptide
  MOD_RES (1)..(1): N-terminal acetylation
  MOD_RES (21)..(21): C-terminal amidation
GYASFPWFVQNHVHKRSWEMA

SEQ ID NO: 2227 - protein, 21 aa, Artificial Sequence
  Synthetic peptide
  MOD_RES (1)..(1): N-terminal acetylation
  MOD_RES (21)..(21): C-terminal amidation
GYASFPWFVQLHVNKRSWEMA

SEQ ID NO: 2228 - protein, 21 aa, Artificial Sequence
  Synthetic peptide
  MOD_RES (1)..(1): N-terminal acetylation
  MOD_RES (21)..(21): C-terminal N-methyl
GYASFPWFVQLHVHKRSWNMA

SEQ ID NO: 2229 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWENA

SEQ ID NO: 2230 - protein, 21 aa, Artificial Sequence
  Synthetic peptide
  MOD_RES (1)..(1): N-terminal acetylation
  MOD_RES (21)..(21): C-terminal amidation
GPASFPWFVQLHVHKRSWEMA

SEQ ID NO: 2231 - protein, 21 aa, Artificial Sequence
  Synthetic peptide
  MOD_RES (1)..(1): N-terminal acetylation
  MOD_RES (21)..(21): C-terminal amidation
GYPSFPWFVQLHVHKRSWEMA

SEQ ID NO: 2232 - protein, 21 aa, Artificial Sequence
  Synthetic peptide
  MOD_RES (1)..(1): N-terminal acetylation
  MOD_RES (21)..(21): C-terminal amidation
GYASPPWFVQLHVHKRSWEMA

SEQ ID NO: 2233 - protein, 21 aa, Artificial Sequence
  Synthetic peptide
  MOD_RES (1)..(1): N-terminal acetylation
  MOD_RES (21)..(21): C-terminal amidation
GYASFPWPVQLHVHKRSWEMA

SEQ ID NO: 2234 - protein, 21 aa, Artificial Sequence
  Synthetic peptide
  MOD_RES (1)..(1): N-terminal acetylation
  MOD_RES (21)..(21): C-terminal amidation
GYASFPWFVPLHVHKRSWEMA

SEQ ID NO: 2235 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWPMA

SEQ ID NO: 2236 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMP

SEQ ID NO: 2237 - protein, 21 aa, Artificial Sequence
  Synthetic peptide
  MOD_RES (1)..(1): N-terminal acetylation
  MOD_RES (21)..(21): C-terminal amidation
QYASFPWFVQLHVHKRSWEMA

SEQ ID NO: 2238 - protein, 21 aa, Artificial Sequence
  Synthetic peptide
  MOD_RES (1)..(1): N-terminal acetylation
  MOD_RES (21)..(21): C-terminal amidation
GYQSFPWFVQLHVHKRSWEMA

SEQ ID NO: 2239 - protein, 21 aa, Artificial Sequence
  Synthetic peptide
  MOD_RES (1)..(1): N-terminal acetylation
  MOD_RES (21)..(21): C-terminal amidation
GYAQFPWFVQLHVHKRSWEMA

SEQ ID NO: 2240 - protein, 21 aa, Artificial Sequence
  Synthetic peptide
  MOD_RES (1)..(1): N-terminal acetylation
  MOD_RES (21)..(21): C-terminal amidation
GYASQPWFVQLHVHKRSWEMA

SEQ ID NO: 2241 - protein, 21 aa, Artificial Sequence
  Synthetic peptide
  MOD_RES (1)..(1): N-terminal acetylation
  MOD_RES (21)..(21): C-terminal amidation
GYASFPWQVQLHVHKRSWEMA

SEQ ID NO: 2242 - protein, 21 aa, Artificial Sequence
  Synthetic peptide
  MOD_RES (1)..(1): N-terminal acetylation
  MOD_RES (21)..(21): C-terminal amidation
GYASFPWFVQQHVHKRSWEMA

SEQ ID NO: 2243 - protein, 21 aa, Artificial Sequence
  Synthetic peptide
  MOD_RES (1)..(1): N-terminal acetylation
  MOD_RES (21)..(21): C-terminal amidation
GYASFPWFVQLHVQKRSWEMA

SEQ ID NO: 2244 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSQEMA

SEQ ID NO: 2245 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWQMA

SEQ ID NO: 2246 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEQA

SEQ ID NO: 2247 - protein, 21 aa, Artificial Sequence
  Synthetic peptide
  MOD_RES (1)..(1): N-terminal acetylation
  MOD_RES (21)..(21): C-terminal amidation
GYASFRWFVQLHVHKRSWEMA

SEQ ID NO: 2248 - protein, 21 aa, Artificial Sequence
  Synthetic peptide
  MOD_RES (1)..(1): N-terminal acetylation
  MOD_RES (21)..(21): C-terminal amidation
GYASFPWFVQLRVHKRSWEMA

SEQ ID NO: 2249 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWERA

SEQ ID NO: 2250 - protein, 21 aa, Artificial Sequence
  Synthetic peptide
  MOD_RES (1)..(1): N-terminal acetylation
  MOD_RES (21)..(21): C-terminal amidation
GSASFPWFVQLHVHKRSWEMA

SEQ ID NO: 2251 - protein, 21 aa, Artificial Sequence
  Synthetic peptide
  MOD_RES (1)..(1): N-terminal acetylation
  MOD_RES (21)..(21): C-terminal amidation
GYASSPWFVQLHVHKRSWEMA

SEQ ID NO: 2252 - protein, 21 aa, Artificial Sequence
  Synthetic peptide
  MOD_RES (1)..(1): N-terminal acetylation
  MOD_RES (21)..(21): C-terminal amidation
GYASFPSFVQLHVHKRSWEMA

SEQ ID NO: 2253 - protein, 21 aa, Artificial Sequence
  Synthetic peptide
  MOD_RES (1)..(1): N-terminal acetylation
  MOD_RES (21)..(21): C-terminal amidation
GYASFPWSVQLHVHKRSWEMA

SEQ ID NO: 2254 - protein, 21 aa, Artificial Sequence
  Synthetic peptide
  MOD_RES (1)..(1): N-terminal acetylation
  MOD_RES (21)..(21): C-terminal amidation
GYASFPWFSQLHVHKRSWEMA

SEQ ID NO: 2255 - protein, 21 aa, Artificial Sequence
  Synthetic peptide
  MOD_RES (1)..(1): N-terminal acetylation
  MOD_RES (21)..(21): C-terminal amidation
GYASFPWFVQSHVHKRSWEMA

SEQ ID NO: 2256 - protein, 21 aa, Artificial Sequence
  Synthetic peptide
  MOD_RES (1)..(1): N-terminal acetylation
  MOD_RES (21)..(21): C-terminal amidation
GYASFPWFVQLHSHKRSWEMA

SEQ ID NO: 2257 - protein, 21 aa, Artificial Sequence
  Synthetic peptide
  MOD_RES (1)..(1): N-terminal acetylation
  MOD_RES (21)..(21): C-terminal amidation
GYASFPWFVQLHVSKRSWEMA

SEQ ID NO: 2258 - protein, 21 aa, Artificial Sequence
  Synthetic peptide
  MOD_RES (1)..(1): N-terminal acetylation
  MOD_RES (21)..(21): C-terminal amidation
GTASFPWFVQLHVHKRSWEMA

SEQ ID NO: 2259 - protein, 21 aa, Artificial Sequence
  Synthetic peptide
  MOD_RES (1)..(1): N-terminal acetylation
  MOD_RES (21)..(21): C-terminal amidation
GYASTPWFVQLHVHKRSWEMA

SEQ ID NO: 2260 - protein, 21 aa, Artificial Sequence
  Synthetic peptide
  MOD_RES (1)..(1): N-terminal acetylation
  MOD_RES (21)..(21): C-terminal amidation
GYASFPTFVQLHVHKRSWEMA

SEQ ID NO: 2261 - protein, 21 aa, Artificial Sequence
  Synthetic peptide
  MOD_RES (1)..(1): N-terminal acetylation
  MOD_RES (21)..(21): C-terminal amidation
GYASFPWTVQLHVHKRSWEMA

SEQ ID NO: 2262 - protein, 21 aa, Artificial Sequence
  Synthetic peptide
  MOD_RES (1)..(1): N-terminal acetylation
  MOD_RES (21)..(21): C-terminal amidation
GYASFPWFTQLHVHKRSWEMA

SEQ ID NO: 2263 - protein, 21 aa, Artificial Sequence
  Synthetic peptide
  MOD_RES (1)..(1): N-terminal acetylation
  MOD_RES (21)..(21): C-terminal amidation
GYASFPWFVTLHVHKRSWEMA

SEQ ID NO: 2264 - protein, 21 aa, Artificial Sequence
  Synthetic peptide
  MOD_RES (1)..(1): N-terminal acetylation
  MOD_RES (21)..(21): C-terminal amidation
GYASFPWFVQTHVHKRSWEMA

SEQ ID NO: 2265 - protein, 21 aa, Artificial Sequence
  Synthetic peptide
  MOD_RES (1)..(1): N-terminal acetylation
  MOD_RES (21)..(21): C-terminal amidation
GYASFPWFVQLHVTKRSWEMA

SEQ ID NO: 2266 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMT

SEQ ID NO: 2267 - protein, 21 aa, Artificial Sequence
  Synthetic peptide
  MOD_RES (1)..(1): N-terminal acetylation
  MOD_RES (21)..(21): C-terminal amidation
GYAVFPWFVQLHVHKRSWEMA

SEQ ID NO: 2268 - protein, 21 aa, Artificial Sequence
  Synthetic peptide
  MOD_RES (1)..(1): N-terminal acetylation
  MOD_RES (21)..(21): C-terminal amidation
GYASVPWFVQLHVHKRSWEMA

SEQ ID NO: 2269 - protein, 21 aa, Artificial Sequence
  Synthetic peptide
  MOD_RES (1)..(1): N-terminal acetylation
  MOD_RES (21)..(21): C-terminal amidation
GYASFPWFVVLHVHKRSWEMA

SEQ ID NO: 2270 - protein, 21 aa, Artificial Sequence
  Synthetic peptide
  MOD_RES (1)..(1): N-terminal acetylation
  MOD_RES (21)..(21): C-terminal amidation
GYASFPWFVQLHVVKRSWEMA

SEQ ID NO: 2271 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSVEMA

SEQ ID NO: 2272 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWVMA

SEQ ID NO: 2273 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEVA

SEQ ID NO: 2274 - protein, 21 aa, Artificial Sequence
  Synthetic peptide
  MOD_RES (1)..(1): N-terminal acetylation
  MOD_RES (21)..(21): C-terminal amidation
WYASFPWFVQLHVHKRSWEMA

SEQ ID NO: 2275 - protein, 21 aa, Artificial Sequence
  Synthetic peptide
  MOD_RES (1)..(1): N-terminal acetylation
  MOD_RES (21)..(21): C-terminal amidation
GYAWFPWFVQLHVHKRSWEMA

SEQ ID NO: 2276 - protein, 21 aa, Artificial Sequence
  Synthetic peptide
  MOD_RES (1)..(1): N-terminal acetylation
  MOD_RES (21)..(21): C-terminal amidation
GYASFPWFWQLHVHKRSWEMA

SEQ ID NO: 2277 - protein, 21 aa, Artificial Sequence
  Synthetic peptide
  MOD_RES (1)..(1): N-terminal acetylation
  MOD_RES (21)..(21): C-terminal amidation
GYASFPWFVWLHVHKRSWEMA

SEQ ID NO: 2278 - protein, 21 aa, Artificial Sequence
  Synthetic peptide
  MOD_RES (1)..(1): N-terminal acetylation
  MOD_RES (21)..(21): C-terminal amidation
GYASFPWFVQLHWHKRSWEMA

SEQ ID NO: 2279 - protein, 21 aa, Artificial Sequence
  Synthetic peptide
  MOD_RES (1)..(1): N-terminal acetylation
  MOD_RES (21)..(21): C-terminal amidation
GYASFPWFVQLHVWKRSWEMA

SEQ ID NO: 2280 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRWWEMA

SEQ ID NO: 2281 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWWMA

SEQ ID NO: 2282 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEWA

SEQ ID NO: 2283 - protein, 21 aa, Artificial Sequence
  Synthetic peptide
  MOD_RES (1)..(1): N-terminal acetylation
  MOD_RES (21)..(21): C-terminal amidation
GYYSFPWFVQLHVHKRSWEMA

SEQ ID NO: 2284 - protein, 21 aa, Artificial Sequence
  Synthetic peptide
  MOD_RES (1)..(1): N-terminal acetylation
  MOD_RES (20)..(20): C-terminal amidation
GYAYFPWFVQLHVHKRSWEMA

SEQ ID NO: 2285 - protein, 21 aa, Artificial Sequence
  Synthetic peptide
  MOD_RES (1)..(1): N-terminal acytlation
  MOD_RES (21)..(21): C-terminal amidation
GYASYPWFVQLHVHKRSWEMA

SEQ ID NO: 2286 - protein, 21 aa, Artificial Sequence
  Synthetic peptide
  MOD_RES (1)..(1): N-terminal acetylation
  MOD_RES (21)..(21): C-terminal amidation
GYASFPYFVQLHVHKRSWEMA

SEQ ID NO: 2287 - protein, 21 aa, Artificial Sequence
  Synthetic peptide
  MOD_RES (1)..(1): N-terminal acetylation
  MOD_RES (21)..(21): C-terminal amidation
GYASFPWFYQLHVHKRSWEMA

SEQ ID NO: 2288 - protein, 21 aa, Artificial Sequence
  Synthetic peptide
  MOD_RES (1)..(1): N-terminal acetylation
  MOD_RES (21)..(21): C-terminal amidation
GYASFPWFVYLHVHKRSWEMA

SEQ ID NO: 2289 - protein, 21 aa, Artificial Sequence
  Synthetic peptide
  MOD_RES (1)..(1): N-terminal acetylation
  MOD_RES (21)..(21): C-terminal amidation
GYASFPWFVQYHVHKRSWEMA

SEQ ID NO: 2290 - protein, 21 aa, Artificial Sequence
  Synthetic peptide
  MOD_RES (1)..(1): N-terminal acetylation
  MOD_RES (21)..(21): C-terminal amidation
GYASFPWFVQLHYHKRSWEMA

SEQ ID NO: 2291 - protein, 21 aa, Artificial Sequence
  Synthetic peptide
  MOD_RES (1)..(1): N-terminal acetylation
  MOD_RES (21)..(21): C-terminal amidation
GYASFPWFVQLHVYKRSWEMA

SEQ ID NO: 2292 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRYWEMA

SEQ ID NO: 2293 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSYEMA

SEQ ID NO: 2294 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWYMA

SEQ ID NO: 2295 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEYA

SEQ ID NO: 2296 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMY

SEQ ID NO: 2297 - protein, 30 aa, Artificial Sequence
  Synthetic peptide
  MOD_RES (1)..(1): N-terminal acetylation
  MOD_RES (21)..(21): C-terminal amidation
KMQLRVYASTAHSRYLLGSSLFPKYAEVKA

SEQ ID NO: 2298 - protein, 32 aa, Artificial Sequence
  Synthetic peptide
  MOD_RES (1)..(1): N-terminal acetylation
  MOD_RES (21)..(21): C-terminal amidation
KKSGYASFPLAVQLHVSKRSKEMALARLYYKK

SEQ ID NO: 2299 - protein, 26 aa, Artificial Sequence
  Synthetic peptide
  MOD_RES (1)..(1): N-terminal acetylation
  MOD_RES (21)..(21): C-terminal amidation
KKSGYASFPLAVQLHVSKRSKEMAKK

SEQ ID NO: 2300 - protein, 23 aa, Artificial Sequence
  Synthetic peptide
  MOD_RES (1)..(1): N-terminal acetylation
  MOD_RES (21)..(21): C-terminal amidation
KKSGYASFPLAVQLHVSKRSKKK

SEQ ID NO: 2301 - protein, 26 aa, Artificial Sequence
  Synthetic peptide
  MOD_RES (1)..(1): N-terminal acetylation
  MOD_RES (26)..(26): C-terminal amidation
KKVQLHVSKRSKEMALARLYYKTSKK

SEQ ID NO: 2302 - protein, 23 aa, Artificial Sequence
  Synthetic peptide
  MOD_RES (1)..(1): N-terminal acetylation
  MOD_RES (23)..(23): C-terminal amidation
KKHVSKRSKEMALARLYYKTSKK

SEQ ID NO: 2303 - protein, 24 aa, Artificial Sequence
  Synthetic peptide
  MOD_RES (1)..(1): N-terminal acetylation
  MOD_RES (24)..(24): C-terminal amidation
KKGYASFPLAVQLHVSKRSKEMKK

SEQ ID NO: 2304 - protein, 24 aa, Artificial Sequence
  Synthetic peptide
  MOD_RES (1)..(1): N-terminal acetylation
  MOD_RES (24)..(24): C-terminal amidation
KKYASFPLAVQLHVSKRSKEMAKK

SEQ ID NO: 2305 - protein, 24 aa, Artificial Sequence
  Synthetic peptide
  MOD_RES (1)..(1): N-terminal acetylation
  MOD_RES (24)..(24): C-terminal amidation
KKVQLHVSKRSKEMALARLYYKKK

SEQ ID NO: 2306 - protein, 24 aa, Artificial Sequence
  Synthetic peptide
  MOD_RES (1)..(1): N-terminal acetylation
  MOD_RES (24)..(24): C-terminal amidation
KKQLHVSKRSKEMALARLYYKTKK

SEQ ID NO: 2307 - protein, 24 aa, Artificial Sequence
  Synthetic peptide
  MOD_RES (1)..(1): N-terminal acetylation
  MOD_RES (24)..(24): C-terminal amidation
KKLHVSKRSKEMALARLYYKTSKK

SEQ ID NO: 2308 - protein, 24 aa, Artificial Sequence
  Synthetic peptide
  MOD_RES (1)..(1): N-terminal acetylation
  MOD_RES (24)..(24): C-terminal amidation
KKSGYASFPLAVQLHVSKRSKEKK

SEQ ID NO: 2309 - protein, 19 aa, Artificial Sequence
  Synthetic peptide
  MOD_RES (1)..(1): N-terminal acetylation
  MOD_RES (19)..(19): C-terminal amidation
ASFPLAVQLHVSKRSKEMA

SEQ ID NO: 2310 - protein, 18 aa, Artificial Sequence
  Synthetic peptide
  MOD_RES (1)..(1): N-terminal acetylation
  MOD_RES (18)..(18): C-terminal amidation
SFPLAVQLHVSKRSKEMA

SEQ ID NO: 2311 - protein, 17 aa, Artificial Sequence
  Synthetic peptide
  MOD_RES (1)..(1): N-terminal acetylation
  MOD_RES (17)..(17): C-terminal amidation
FPLAVQLHVSKRSKEMA

SEQ ID NO: 2312 - protein, 18 aa, Artificial Sequence
  Synthetic peptide
  MOD_RES (1)..(1): N-terminal acetylation
  MOD_RES (18)..(18): C-terminal amidation
ASFPLAVQLHVSKRSKEM

SEQ ID NO: 2313 - protein, 17 aa, Artificial Sequence
  Synthetic peptide
  MOD_RES (1)..(1): N-terminal acetylation
  MOD_RES (17)..(17): C-terminal amidation
ASFPLAVQLHVSKRSKE

SEQ ID NO: 2314 - protein, 20 aa, Artificial Sequence
  Synthetic peptide
  MOD_RES (1)..(1): N-terminal acetylation
  MOD_RES (20)..(20): C-terminal amidation
ASFPLAVQLHVSKRSKEMAL

SEQ ID NO: 2315 - protein, 21 aa, Artificial Sequence
  Synthetic peptide
  MOD_RES (1)..(1): N-terminal acetylation
  MOD_RES (21)..(21): C-terminal amidation
ASFPLAVQLHVSKRSKEMALA

SEQ ID NO: 2316 - protein, 22 aa, Artificial Sequence
  Synthetic peptide
  MOD_RES (1)..(1): N-terminal acetylation
  MOD_RES (22)..(22): C-terminal amidation
ASFPLAVQLHVSKRSKEMALAR

SEQ ID NO: 2317 - protein, 23 aa, Artificial Sequence
  Synthetic peptide
  MOD_RES (1)..(1): N-terminal acetylation
  MOD_RES (23)..(23): C-terminal amidation
ASFPLAVQLHVSKRSKEMALARL

SEQ ID NO: 2318 - protein, 20 aa, Artificial Sequence
  Synthetic peptide
  MOD_RES (1)..(1): N-terminal acetylation
  MOD_RES (20)..(20): C-terminal amidation
YASFPLAVQLHVSKRSKEMA

SEQ ID NO: 2319 - protein, 21 aa, Artificial Sequence
  Synthetic peptide
  MOD_RES (1)..(1): N-terminal acetylation
  MOD_RES (21)..(21): C-terminal amidation
GYASFPLAVQLHVSKRSKEMA

SEQ ID NO: 2320 - protein, 21 aa, Artificial Sequence
  Synthetic peptide
  MOD_RES (1)..(1): N-terminal acetylation
  MOD_RES (21)..(21): C-terminal amidation
GYASFALSVQLHVSKRSKEMA

SEQ ID NO: 2321 - protein, 21 aa, Artificial Sequence
  Synthetic peptide
  MOD_RES (1)..(1): N-terminal acetylation
  MOD_RES (21)..(21): C-terminal amidation
GYASFALAVQLHVAKRSKEMA

SEQ ID NO: 2322 - protein, 21 aa, Artificial Sequence
  Synthetic peptide
  MOD_RES (1)..(1): N-terminal acetylation
  MOD_RES (21)..(21): C-terminal amidation
GYASFALAVQLHVMKRSKEMA

SEQ ID NO: 2323 - protein, 19 aa, Artificial Sequence
  Synthetic peptide
  MOD_RES (1)..(1): N-terminal acetylation
  MOD_RES (19)..(19): C-terminal amidation
FPLAVQLHVSKRSKEMALA

SEQ ID NO: 2324 - protein, 14 aa, Artificial Sequence
  Synthetic peptide
  MOD_RES (1)..(1): N-terminal acetylation
  MOD_RES (14)..(14): C-terminal amidation
QLHVSKRSKEMALA

SEQ ID NO: 2325 - protein, 7 aa, Artificial Sequence
  Synthetic peptide
  MOD_RES (1)..(1): N-terminal acetylation
  MOD_RES (7)..(7): C-terminal amidation
SGYASFP

SEQ ID NO: 2326 - protein, 19 aa, Artificial Sequence
  Synthetic peptide
  MOD_RES (1)..(1): N-terminal acetylation
  MOD_RES (19)..(19): C-terminal amidation
LAVQLHVSKRSKEMALARL

SEQ ID NO: 2327 - protein, 21 aa, Artificial Sequence
  Synthetic peptide
  MOD_RES (1)..(1): N-terminal acetylation
  MOD_RES (21)..(21): C-terminal amidation
VYASFFLTVQLHVSKRSKEMA

SEQ ID NO: 2328 - protein, 21 aa, Artificial Sequence
  Synthetic peptide
  MOD_RES (1)..(1): N-terminal acetylation
  MOD_RES (21)..(21): C-terminal amidation
GYWSFPQAVQLHVSKRSKEMA

SEQ ID NO: 2329 - protein, 21 aa, Artificial Sequence
  Synthetic peptide
  MOD_RES (1)..(1): N-terminal acetylation
  MOD_RES (21)..(21): C-terminal amidation
GYASFILAVQLHVSKRSKEMA

SEQ ID NO: 2330 - protein, 21 aa, Artificial Sequence
  Synthetic peptide
  MOD_RES (1)..(1): N-terminal acetylation
  MOD_RES (21)..(21): C-terminal amidation
GYWSFYLAVQLHVSKRSKEMA

SEQ ID NO: 2331 - protein, 21 aa, Artificial Sequence
  Synthetic peptide
  MOD_RES (1)..(1): N-terminal acetylation
  MOD_RES (21)..(21): C-terminal amidation
SYASFFLAVQLHVSKRSEEMA

SEQ ID NO: 2332 - protein, 21 aa, Artificial Sequence
  Synthetic peptide
  MOD_RES (1)..(1): N-terminal acetylation
  MOD_RES (21)..(21): C-terminal amidation
GYASFILAVQLHIIKRSKEMA

SEQ ID NO: 2333 - protein, 21 aa, Artificial Sequence
  Synthetic peptide
  MOD_RES (1)..(1): N-terminal acetylation
  MOD_RES (21)..(21): C-terminal amidation
GMASFFLARDLHWSKVFKEMA

SEQ ID NO: 2334 - protein, 21 aa, Artificial Sequence
  Synthetic peptide
  MOD_RES (1)..(1): N-terminal acetylation
  MOD_RES (21)..(21): C-terminal amidation
EYAQFWLAVQLHVSKRSKEMA

SEQ ID NO: 2335 - protein, 21 aa, Artificial Sequence
  Synthetic peptide
  MOD_RES (1)..(1): N-terminal acetylation
  MOD_RES (21)..(21): C-terminal amidation
GYASFPLIVQLHVSKRSKEMA

SEQ ID NO: 2336 - protein, 21 aa, Artificial Sequence
  Synthetic peptide
  MOD_RES (1)..(1): N-terminal acetylation
  MOD_RES (21)..(21): C-terminal amidation
GYASFPIHVQHHVSKRSKEMA

SEQ ID NO: 2337 - protein, 21 aa, Artificial Sequence
  Synthetic peptide
  MOD_RES (1)..(1): N-terminal acetylation
  MOD_RES (21)..(21): C-terminal amidation
GYASFALMVQLHVSKRSKEMA

SEQ ID NO: 2338 - protein, 21 aa, Artificial Sequence
  Synthetic peptide
  MOD_RES (1)..(1): N-terminal acetylation
  MOD_RES (21)..(21): C-terminal amidation
GYASFHQAVQRHVSKRSKEMA

SEQ ID NO: 2339 - protein, 21 aa, Artificial Sequence
  Synthetic peptide
  MOD_RES (1)..(1): N-terminal acetylation
  MOD_RES (21)..(21): C-terminal amidation
GYASFALMVQHHVSKRSKEMA

SEQ ID NO: 2340 - protein, 21 aa, Artificial Sequence
  Synthetic peptide
  MOD_RES (1)..(1): N-terminal acetylation
  MOD_RES (21)..(21): C-terminal amidation
GYASFSLAVQLHVSKRSKEMA

SEQ ID NO: 2341 - protein, 21 aa, Artificial Sequence
  Synthetic peptide
  MOD_RES (1)..(1): N-terminal acetylation
  MOD_RES (21)..(21): C-terminal amidation
GYHSFKLAVQLHVSKRSKEIA

SEQ ID NO: 2342 - protein, 21 aa, Artificial Sequence
  Synthetic peptide
  MOD_RES (1)..(1): N-terminal acetylation
  MOD_RES (21)..(21): C-terminal amidation
GYASYVLAVQHHVSWRSWEMA

SEQ ID NO: 2343 - protein, 21 aa, Artificial Sequence
  Synthetic peptide
  MOD_RES (1)..(1): N-terminal acetylation
  MOD_RES (21)..(21): C-terminal amidation
HYHSLPKQVQLHVSKRSKEMA

SEQ ID NO: 2344 - protein, 21 aa, Artificial Sequence
  Synthetic peptide
  MOD_RES (1)..(1): N-terminal acetylation
  MOD_RES (21)..(21): C-terminal amidation
GYASFSLAVQLHVHKRSYEMA

SEQ ID NO: 2345 - protein, 21 aa, Artificial Sequence
  Synthetic peptide
  MOD_RES (1)..(1): N-terminal acetylation
  MOD_RES (21)..(21): C-terminal amidation
GYASFELLVQLHVSKRSKEMA

SEQ ID NO: 2346 - protein, 21 aa, Artificial Sequence
  Synthetic peptide
  MOD_RES (1)..(1): N-terminal acetylation
  MOD_RES (21)..(21): C-terminal amidation
SYSSFKLAVQLHVSKRSKEMA

SEQ ID NO: 2347 - protein, 21 aa, Artificial Sequence
  Synthetic peptide
  MOD_RES (1)..(1): N-terminal acetylation
  MOD_RES (21)..(21): C-terminal amidation
GYAWFPLNVWLHVHKRSHEMA

SEQ ID NO: 2348 - protein, 21 aa, Artificial Sequence
  Synthetic peptide
  MOD_RES (1)..(1): N-terminal acetylation
  MOD_RES (21)..(21): C-terminal amidation
GYASFWLSVQTHVSKRSKEMA

SEQ ID NO: 2349 - protein, 21 aa, Artificial Sequence
  Synthetic peptide
  MOD_RES (1)..(1): N-terminal acetylation
  MOD_RES (21)..(21): C-terminal amidation
GYASFPLMVQLHVIKRSKEMA

SEQ ID NO: 2350 - protein, 21 aa, Artificial Sequence
  Synthetic peptide
  MOD_RES (1)..(1): N-terminal acetylation
  MOD_RES (21)..(21): C-terminal amidation
GYWSFNLVVQLHVSKRSKEMA

SEQ ID NO: 2351 - protein, 21 aa, Artificial Sequence
  Synthetic peptide
  MOD_RES (1)..(1): N-terminal acetylation
  MOD_RES (21)..(21): C-terminal amidation
GYASFHLAVQLHVWKRSKEMA

SEQ ID NO: 2352 - protein, 21 aa, Artificial Sequence
  Synthetic peptide
  MOD_RES (1)..(1): N-terminal acetylation
  MOD_RES (21)..(21): C-terminal amidation
GYASFWLVVQLHVSKRSKEMA

SEQ ID NO: 2353 - protein, 21 aa, Artificial Sequence
  Synthetic peptide
  MOD_RES (1)..(1): N-terminal acetylation
  MOD_RES (21)..(21): C-terminal amidation
GYWSFPLAVQLHVWKRSWEMA

SEQ ID NO: 2354 - protein, 21 aa, Artificial Sequence
  Synthetic peptide
  MOD_RES (1)..(1): N-terminal acetylation
  MOD_RES (21)..(21): C-terminal amidation
GYASFPWYVQLHVSKRSKEMA

SEQ ID NO: 2355 - protein, 21 aa, Artificial Sequence
  Synthetic peptide
  MOD_RES (1)..(1): N-terminal acetylation
  MOD_RES (21)..(21): C-terminal amidation
GYTSFQLAVQLHVSKRSKEMA

SEQ ID NO: 2356 - protein, 21 aa, Artificial Sequence
  Synthetic peptide
  MOD_RES (1)..(1): N-terminal acetylation
  MOD_RES (21)..(21): C-terminal amidation
RYASFPLAVYLHVTKRSKEMA

SEQ ID NO: 2357 - protein, 21 aa, Artificial Sequence
  Synthetic peptide
  MOD_RES (1)..(1): N-terminal acetylation
  MOD_RES (21)..(21): C-terminal amidation
GYWSFPLAVQLHVSKRLKEMA

SEQ ID NO: 2358 - protein, 21 aa, Artificial Sequence
  Synthetic peptide
  MOD_RES (1)..(1): N-terminal acetylation
  MOD_RES (21)..(21): C-terminal amidation
GHASFQTAVQQHVSKRSKEMA

SEQ ID NO: 2359 - protein, 11 aa, Artificial Sequence
  Synthetic peptide
  MOD_RES (1)..(1): N-terminal acetylation
  MOD_RES (11)..(11): C-terminal amidation
FHVSKRSKEMA

SEQ ID NO: 2360 - protein, 21 aa, Artificial Sequence
  Synthetic peptide
  MOD_RES (1)..(1): N-terminal acetylation
  MOD_RES (21)..(21): C-terminal amidation
GYASFWHAVQLHVSKRSKEMA

SEQ ID NO: 2361 - protein, 21 aa, Artificial Sequence
  Synthetic peptide
  MOD_RES (1)..(1): N-terminal acetylation
  MOD_RES (21)..(21): C-terminal amidation
GIASFILAVQLHVYKRSKEMA

SEQ ID NO: 2362 - protein, 21 aa, Artificial Sequence
  Synthetic peptide
  MOD_RES (1)..(1): N-terminal acetylation
  MOD_RES (21)..(21): C-terminal amidation
GYTSFMQAVQHHVSKRSKEIA

SEQ ID NO: 2363 - protein, 21 aa, Artificial Sequence
  Synthetic peptide
  MOD_RES (1)..(1): N-terminal acetylation
  MOD_RES (21)..(21): C-terminal amidation
HYHSFYLAVQLHVWERSYEMA

SEQ ID NO: 2364 - protein, 21 aa, Artificial Sequence
  Synthetic peptide
  MOD_RES (1)..(1): N-terminal acetylation
  MOD_RES (21)..(21): C-terminal amidation
GYASFWHAVQHHVTKRSREMA

SEQ ID NO: 2365 - protein, 21 aa, Artificial Sequence
  Synthetic peptide
  MOD_RES (1)..(1): N-terminal acetylation
  MOD_RES (21)..(21): C-terminal amidation
GYASFTLTVQLHVSKRSKEMA

SEQ ID NO: 2366 - protein, 21 aa, Artificial Sequence
  Synthetic peptide
  MOD_RES (1)..(1): N-terminal acetylation
  MOD_RES (21)..(21): C-terminal amidation
GYASFILTVQLHVSKRSKEMA

SEQ ID NO: 2367 - protein, 21 aa, Artificial Sequence
  Synthetic peptide
  MOD_RES (1)..(1): N-terminal acetylation
  MOD_RES (21)..(21): C-terminal amidation
GYASFWLAVQIHVSKRSKEMA

SEQ ID NO: 2368 - protein, 21 aa, Artificial Sequence
  Synthetic peptide
  MOD_RES (1)..(1): N-terminal acetylation
  MOD_RES (21)..(21): C-terminal amidation
GYASFILAVQHHVSKRSKEMA

SEQ ID NO: 2369 - protein, 21 aa, Artificial Sequence
  Synthetic peptide
  MOD_RES (1)..(1): N-terminal acetylation
  MOD_RES (21)..(21): C-terminal amidation
SYASFPPAVMLHVWKRSYEMA

SEQ ID NO: 2370 - protein, 21 aa, Artificial Sequence
  Synthetic peptide
  MOD_RES (1)..(1): N-terminal acetylation
  MOD_RES (21)..(21): C-terminal amidation
GYASFNLAVQLHVSKRSKEMA

SEQ ID NO: 2371 - protein, 21 aa, Artificial Sequence
  Synthetic peptide
  MOD_RES (1)..(1): N-terminal acetylation
  MOD_RES (21)..(21): C-terminal amidation
GYWSFNLAVQLHVSKRSKEMA

SEQ ID NO: 2372 - protein, 21 aa, Artificial Sequence
  Synthetic peptide
  MOD_RES (1)..(1): N-terminal acetylation
  MOD_RES (21)..(21): C-terminal amidation
GYASFFLAVQLHVSKRSKEMA

SEQ ID NO: 2373 - protein, 21 aa, Artificial Sequence
  Synthetic peptide
  MOD_RES (1)..(1): N-terminal acetylation
  MOD_RES (21)..(21): C-terminal amidation
GYASFWLAVQMHVWKRSKEMA

SEQ ID NO: 2374 - protein, 21 aa, Artificial Sequence
  Synthetic peptide
  MOD_RES (1)..(1): N-terminal acetylation
  MOD_RES (21)..(21): C-terminal amidation
GYASFSLAIQLHVSKRSKEMA

SEQ ID NO: 2375 - protein, 21 aa, Artificial Sequence
  Synthetic peptide
  MOD_RES (1)..(1): N-terminal acetylation
  MOD_RES (21)..(21): C-terminal amidation
GAASFPWFVQLHVHKRSWEMA

SEQ ID NO: 2376 - protein, 21 aa, Artificial Sequence
  Synthetic peptide
  MOD_RES (1)..(1): N-terminal acetylation
  MOD_RES (21)..(21): C-terminal amidation
GYASAPWFVQLHVHKRSWEMA

SEQ ID NO: 2377 - protein, 21 aa, Artificial Sequence
  Synthetic peptide
  MOD_RES (1)..(1): N-terminal acetylation
  MOD_RES (21)..(21): C-terminal amidation
GYASFAWFVQLHVHKRSWEMA

SEQ ID NO: 2378 - protein, 21 aa, Artificial Sequence
  Synthetic peptide
  MOD_RES (1)..(1): N-terminal acetylation
  MOD_RES (21)..(21): C-terminal amidation
GYASFPWFAQLHVHKRSWEMA

SEQ ID NO: 2379 - protein, 21 aa, Artificial Sequence
  Synthetic peptide
  MOD_RES (1)..(1): N-terminal acetylation
  MOD_RES (21)..(21): C-terminal amidation
GYASFPWFVQLAVHKRSWEMA

SEQ ID NO: 2380 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHARSWEMA

SEQ ID NO: 2381 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKASWEMA

SEQ ID NO: 2382 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSAEMA

SEQ ID NO: 2383 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHCRSWEMA

SEQ ID NO: 2384 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKCSWEMA

SEQ ID NO: 2385 - protein, 21 aa, Artificial Sequence
  Synthetic peptide
  MOD_RES (1)..(1): N-terminal acetylation
  MOD_RES (21)..(21): C-terminal amidation
GYASFDWFVQLHVHKRSWEMA

SEQ ID NO: 2386 - protein, 21 aa, Artificial Sequence
  Synthetic peptide
  MOD_RES (1)..(1): N-terminal acetylation
  MOD_RES (21)..(21): C-terminal amidation
GYASFPDFVQLHVHKRSWEMA

SEQ ID NO: 2387 - protein, 21 aa, Artificial Sequence
  Synthetic peptide
  MOD_RES (1)..(1): N-terminal acetylation
  MOD_RES (21)..(21): C-terminal amidation
GYASFPWDVQLHVHKRSWEMA

SEQ ID NO: 2388 - protein, 21 aa, Artificial Sequence
  Synthetic peptide
  MOD_RES (1)..(1): N-terminal acetylation
  MOD_RES (21)..(21): C-terminal amidation
GYASFPWFDQLHVHKRSWEMA

SEQ ID NO: 2389 - protein, 21 aa, Artificial Sequence
  Synthetic peptide
  MOD_RES (1)..(1): N-terminal acetylation
  MOD_RES (21)..(21): C-terminal amidation
GYASFPWFVDLHVHKRSWEMA

SEQ ID NO: 2390 - protein, 21 aa, Artificial Sequence
  Synthetic peptide
  MOD_RES (1)..(1): N-terminal acetylation
  MOD_RES (21)..(21): C-terminal amidation
GYASFPWFVQDHVHKRSWEMA

SEQ ID NO: 2391 - protein, 21 aa, Artificial Sequence
  Synthetic peptide
  MOD_RES (1)..(1): N-terminal acetylation
  MOD_RES (21)..(21): C-terminal amidation
GYASFPWFVQLDVHKRSWEMA

SEQ ID NO: 2392 - protein, 21 aa, Artificial Sequence
  Synthetic peptide
  MOD_RES (1)..(1): N-terminal acetylation
  MOD_RES (21)..(21): C-terminal amidation
GYASFPWFVQLHDHKRSWEMA

SEQ ID NO: 2393 - protein, 21 aa, Artificial Sequence
  Synthetic peptide
  MOD_RES (1)..(1): N-terminal acetylation
  MOD_RES (21)..(21): C-terminal amidation
GYASFPWFVQLHVDKRSWEMA

SEQ ID NO: 2394 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHDRSWEMA

SEQ ID NO: 2395 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKDSWEMA

SEQ ID NO: 2396 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRDWEMA

SEQ ID NO: 2397 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSDEMA

SEQ ID NO: 2398 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEDA

SEQ ID NO: 2399 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMD

SEQ ID NO: 2400 - protein, 21 aa, Artificial Sequence
  Synthetic peptide
  MOD_RES (1)..(1): N-terminal acetylation
  MOD_RES (21)..(21): C-terminal amidation
GEASFPWFVQLHVHKRSWEMA

SEQ ID NO: 2401 - protein, 21 aa, Artificial Sequence
  Synthetic peptide
  MOD_RES (17)..(17): Xaa is 2-Amino-isobutyric acid
  MOD_RES (21)..(21): C-terminal amidation
GYASEPWFVQLHVHKRSWEMA

SEQ ID NO: 2402 - protein, 21 aa, Artificial Sequence
  Synthetic peptide
  MOD_RES (1)..(1): N-terminal acetylation
  MOD_RES (21)..(21): C-terminal amidation
GYASFEWFVQLHVHKRSWEMA

SEQ ID NO: 2403 - protein, 21 aa, Artificial Sequence
  Synthetic peptide
  MOD_RES (1)..(1): N-terminal acetylation
  MOD_RES (21)..(21): C-terminal amidation
GYASFPEFVQLHVHKRSWEMA

SEQ ID NO: 2404 - protein, 21 aa, Artificial Sequence
  Synthetic peptide
  MOD_RES (1)..(1): N-terminal acetylation
  MOD_RES (21)..(21): C-terminal amidation
GYASFPWEVQLHVHKRSWEMA

SEQ ID NO: 2405 - protein, 21 aa, Artificial Sequence
  Synthetic peptide
  MOD_RES (1)..(1): N-terminal acetylation
  MOD_RES (21)..(21): C-terminal amidation
GYASFPWFEQLHVHKRSWEMA

SEQ ID NO: 2406 - protein, 21 aa, Artificial Sequence
  Synthetic peptide
  MOD_RES (1)..(1): N-terminal acetylation
  MOD_RES (21)..(21): C-terminal amidation
GYASFPWFVELHVHKRSWEMA

SEQ ID NO: 2407 - protein, 21 aa, Artificial Sequence
  Synthetic peptide
  MOD_RES (1)..(1): N-terminal acetylation
  MOD_RES (21)..(21): C-terminal amidation
GYASFPWFVQEHVHKRSWEMA

SEQ ID NO: 2408 - protein, 21 aa, Artificial Sequence
  Synthetic peptide
  MOD_RES (1)..(1): N-terminal acetylation
  MOD_RES (21)..(21): C-terminal amidation
GYASFPWFVQLEVHKRSWEMA

SEQ ID NO: 2409 - protein, 21 aa, Artificial Sequence
  Synthetic peptide
  MOD_RES (1)..(1): N-terminal acetylation
  MOD_RES (21)..(21): C-terminal amidation
GYASFPWFVQLHEHKRSWEMA

SEQ ID NO: 2410 - protein, 21 aa, Artificial Sequence
  Synthetic peptide
  MOD_RES (1)..(1): N-terminal acetylation
  MOD_RES (21)..(21): C-terminal amidation
GYASFPWFVQLHVEKRSWEMA

SEQ ID NO: 2411 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHERSWEMA

SEQ ID NO: 2412 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKESWEMA

SEQ ID NO: 2413 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKREWEMA

SEQ ID NO: 2414 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSEEMA

SEQ ID NO: 2415 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEEA

SEQ ID NO: 2416 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEME

SEQ ID NO: 2417 - protein, 21 aa, Artificial Sequence
  Synthetic peptide
  MOD_RES (1)..(1): N-terminal acetylation
  MOD_RES (21)..(21): C-terminal amidation
GYASFFWFVQLHVHKRSWEMA

SEQ ID NO: 2418 - protein, 21 aa, Artificial Sequence
  Synthetic peptide
  MOD_RES (1)..(1): N-terminal acetylation
  MOD_RES (21)..(21): C-terminal amidation
GYASFPWFVQLFVHKRSWEMA

SEQ ID NO: 2419 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHFRSWEMA

SEQ ID NO: 2420 - protein, 21 aa, Artificial Sequence
  Synthetic peptide
  MOD_RES (1)..(1): N-terminal acetylation
  MOD_RES (21)..(21): C-terminal amidation
GYASFGWFVQLHVHKRSWEMA

SEQ ID NO: 2421 - protein, 21 aa, Artificial Sequence
  Synthetic peptide
  MOD_RES (1)..(1): N-terminal acetylation
  MOD_RES (21)..(21): C-terminal amidation
GYASFPWFVQLGVHKRSWEMA

SEQ ID NO: 2422 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHGRSWEMA

SEQ ID NO: 2423 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKGSWEMA

SEQ ID NO: 2424 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSGEMA

SEQ ID NO: 2425 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHHRSWEMA

SEQ ID NO: 2426 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKHSWEMA

SEQ ID NO: 2427 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSHEMA

SEQ ID NO: 2428 - protein, 21 aa, Artificial Sequence
  Synthetic peptide
  MOD_RES (1)..(1): N-terminal acetylation
  MOD_RES (21)..(21): C-terminal amidation
GYASFIWFVQLHVHKRSWEMA

SEQ ID NO: 2429 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHIRSWEMA

SEQ ID NO: 2430 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKISWEMA

SEQ ID NO: 2431 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKKSWEMA

SEQ ID NO: 2432 - protein, 21 aa, Artificial Sequence
  Synthetic peptide
  MOD_RES (1)..(1): N-terminal acetylation
  MOD_RES (21)..(21): C-terminal amidation
GYASFLWFVQLHVHKRSWEMA

SEQ ID NO: 2433 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHLRSWEMA

SEQ ID NO: 2434 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKLSWEMA

SEQ ID NO: 2435 - protein, 21 aa, Artificial Sequence
  Synthetic peptide
  MOD_RES (1)..(1): N-terminal acetylation
  MOD_RES (21)..(21): C-terminal amidation
GYASFMWFVQLHVHKRSWEMA

SEQ ID NO: 2436 - protein, 21 aa, Artificial Sequence
  Synthetic peptide
  MOD_RES (1)..(1): N-terminal acetylation
  MOD_RES (21)..(21): C-terminal amidation
GYASFPMFVQLHVHKRSWEMA

SEQ ID NO: 2437 - protein, 21 aa, Artificial Sequence
  Synthetic peptide
  MOD_RES (1)..(1): N-terminal acetylation
  MOD_RES (21)..(21): C-terminal amidation
GYASFPWFVQLMVHKRSWEMA

SEQ ID NO: 2438 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHMRSWEMA

SEQ ID NO: 2439 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKMSWEMA

SEQ ID NO: 2440 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWMMA

SEQ ID NO: 2441 - protein, 21 aa, Artificial Sequence
  Synthetic peptide
  MOD_RES (1)..(1): N-terminal acetylation
  MOD_RES (21)..(21): C-terminal amidation
GYASFNWFVQLHVHKRSWEMA

SEQ ID NO: 2442 - protein, 21 aa, Artificial Sequence
  Synthetic peptide
  MOD_RES (1)..(1): N-terminal acetylation
  MOD_RES (21)..(21): C-terminal amidation
GYASFPWFNQLHVHKRSWEMA

SEQ ID NO: 2443 - protein, 21 aa, Artificial Sequence
  Synthetic peptide
  MOD_RES (1)..(1): N-terminal acetylation
  MOD_RES (21)..(21): C-terminal amidation
GYASFPWFVQLNVHKRSWEMA

SEQ ID NO: 2444 - protein, 21 aa, Artificial Sequence
  Synthetic peptide
  MOD_RES (1)..(1): N-terminal acetylation
  MOD_RES (21)..(21): C-terminal amidation
GYASFPWFVQLHNHKRSWEMA

SEQ ID NO: 2445 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHNRSWEMA

SEQ ID NO: 2446 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKNSWEMA

SEQ ID NO: 2447 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSNEMA

SEQ ID NO: 2448 - protein, 21 aa, Artificial Sequence
  Synthetic peptide
  MOD_RES (1)..(1): N-terminal acetylation
  MOD_RES (21)..(21): C-terminal amidation
GYASFPPFVQLHVHKRSWEMA

SEQ ID NO: 2449 - protein, 21 aa, Artificial Sequence
  Synthetic peptide
  MOD_RES (1)..(1): N-terminal acetylation
  MOD_RES (21)..(21): C-terminal amidation
GYASFPWFPQLHVHKRSWEMA

SEQ ID NO: 2450 - protein, 21 aa, Artificial Sequence
  Synthetic peptide
  MOD_RES (1)..(1): N-terminal acetylation
  MOD_RES (21)..(21): C-terminal amidation
GYASFPWFVQPHVHKRSWEMA

SEQ ID NO: 2451 - protein, 21 aa, Artificial Sequence
  Synthetic peptide
  MOD_RES (1)..(1): N-terminal acetylation
  MOD_RES (21)..(21): C-terminal amidation
GYASFPWFVQLPVHKRSWEMA

SEQ ID NO: 2452 - protein, 21 aa, Artificial Sequence
  Synthetic peptide
  MOD_RES (1)..(1): N-terminal acetylation
  MOD_RES (21)..(21): C-terminal amidation
GYASFPWFVQLHPHKRSWEMA

SEQ ID NO: 2453 - protein, 21 aa, Artificial Sequence
  Synthetic peptide
  MOD_RES (1)..(1): N-terminal acetylation
  MOD_RES (21)..(21): C-terminal amidation
GYASFPWFVQLHVPKRSWEMA

SEQ ID NO: 2454 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHPRSWEMA

SEQ ID NO: 2455 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKPSWEMA

SEQ ID NO: 2456 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRPWEMA

SEQ ID NO: 2457 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSPEMA

SEQ ID NO: 2458 - protein, 21 aa, Artificial Sequence
  Synthetic peptide
  MOD_RES (1)..(1): N-terminal acetylation
  MOD_RES (21)..(21): C-terminal amidation
GQASFPWFVQLHVHKRSWEMA

SEQ ID NO: 2459 - protein, 21 aa, Artificial Sequence
  Synthetic peptide
  MOD_RES (1)..(1): N-terminal acetylation
  MOD_RES (21)..(21): C-terminal amidation
GYASFQWFVQLHVHKRSWEMA

SEQ ID NO: 2460 - protein, 21 aa, Artificial Sequence
  Synthetic peptide
  MOD_RES (1)..(1): N-terminal acetylation
  MOD_RES (21)..(21): C-terminal amidation
GYASFPQFVQLHVHKRSWEMA

SEQ ID NO: 2461 - protein, 21 aa, Artificial Sequence
  Synthetic peptide
  MOD_RES (1)..(1): N-terminal acetylation
  MOD_RES (21)..(21): C-terminal amidation
GYASFPWFQQLHVHKRSWEMA

SEQ ID NO: 2462 - protein, 21 aa, Artificial Sequence
  Synthetic peptide
  MOD_RES (1)..(1): N-terminal acetylation
  MOD_RES (20)..(20): C-terminal amidation
GYASFPWFVQLQVHKRSWEMA

SEQ ID NO: 2463 - protein, 21 aa, Artificial Sequence
  Synthetic peptide
  MOD_RES (1)..(1): N-terminal acetylation
  MOD_RES (21)..(21): C-terminal amidation
GYASFPWFVQLHQHKRSWEMA

SEQ ID NO: 2464 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHQRSWEMA

SEQ ID NO: 2465 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKQSWEMA

SEQ ID NO: 2466 - protein, 21 aa, Artificial Sequence
  Synthetic peptide
  MOD_RES (1)..(1): N-terminal acetylation
  MOD_RES (21)..(21): C-terminal amidation
GYASFSWFVQLHVHKRSWEMA

SEQ ID NO: 2467 - protein, 21 aa, Artificial Sequence
  Synthetic peptide
  MOD_RES (1)..(1): N-terminal acetylation
  MOD_RES (21)..(21): C-terminal amidation
GYASFPWFVQLSVHKRSWEMA

SEQ ID NO: 2468 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHSRSWEMA

SEQ ID NO: 2469 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKSSWEMA

SEQ ID NO: 2470 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSSEMA

SEQ ID NO: 2471 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWSMA

SEQ ID NO: 2472 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWESA

SEQ ID NO: 2473 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWEMS

SEQ ID NO: 2474 - protein, 21 aa, Artificial Sequence
  Synthetic peptide
  MOD_RES (1)..(1): N-terminal acetylation
  MOD_RES (21)..(21): C-terminal amidation
GYASFTWFVQLHVHKRSWEMA

SEQ ID NO: 2475 - protein, 21 aa, Artificial Sequence
  Synthetic peptide
  MOD_RES (1)..(1): N-terminal acetylation
  MOD_RES (21)..(21): C-terminal amidation
GYASFPWFVQLTVHKRSWEMA

SEQ ID NO: 2476 - protein, 21 aa, Artificial Sequence
  Synthetic peptide
  MOD_RES (1)..(1): N-terminal acetylation
  MOD_RES (21)..(21): C-terminal amidation
GYASFPWFVQLHTHKRSWEMA

SEQ ID NO: 2477 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHTRSWEMA

SEQ ID NO: 2478 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKTSWEMA

SEQ ID NO: 2479 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSTEMA

SEQ ID NO: 2480 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWTMA

SEQ ID NO: 2481 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKRSWETA

SEQ ID NO: 2482 - protein, 21 aa, Artificial Sequence
  Synthetic peptide
  MOD_RES (1)..(1): N-terminal acetylation
  MOD_RES (21)..(21): C-terminal amidation
VYASFPWFVQLHVHKRSWEMA

SEQ ID NO: 2483 - protein, 21 aa, Artificial Sequence
  Synthetic peptide
  MOD_RES (1)..(1): N-terminal acetylation
  MOD_RES (21)..(21): C-terminal amidation
GVASFPWFVQLHVHKRSWEMA

SEQ ID NO: 2484 - protein, 21 aa, Artificial Sequence
  Synthetic peptide
  MOD_RES (1)..(1): N-terminal acetylation
  MOD_RES (21)..(21): C-terminal amidation
GYVSFPWFVQLHVHKRSWEMA

SEQ ID NO: 2485 - protein, 21 aa, Artificial Sequence
  Synthetic peptide
  MOD_RES (1)..(1): N-terminal acetylation
  MOD_RES (21)..(21): C-terminal amidation
GYASFVWFVQLHVHKRSWEMA

SEQ ID NO: 2486 - protein, 21 aa, Artificial Sequence
  Synthetic peptide
  MOD_RES (20)..(20): C-terminal amidation
  MOD_RES (21)..(21): N-terminal acetylation
GYASFPVFVQLHVHKRSWEMA

SEQ ID NO: 2487 - protein, 21 aa, Artificial Sequence
  Synthetic peptide
  MOD_RES (1)..(1): N-terminal acetylation
  MOD_RES (21)..(21): C-terminal amidation
GYASFPWFVQLVVHKRSWEMA

SEQ ID NO: 2488 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHVRSWEMA

SEQ ID NO: 2489 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKVSWEMA

SEQ ID NO: 2490 - protein, 21 aa, Artificial Sequence
  Synthetic peptide
  MOD_RES (1)..(1): N-terminal acetylation
  MOD_RES (21)..(21): C-terminal amidation
GYASFWWFVQLHVHKRSWEMA

SEQ ID NO: 2491 - protein, 21 aa, Artificial Sequence
  Synthetic peptide
  MOD_RES (1)..(1): N-terminal acetylation
  MOD_RES (21)..(21): C-terminal amidation
GYASFPWFVQLWVHKRSWEMA

SEQ ID NO: 2492 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHWRSWEMA

SEQ ID NO: 2493 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKWSWEMA

SEQ ID NO: 2494 - protein, 21 aa, Artificial Sequence
  Synthetic peptide
  MOD_RES (1)..(1): N-terminal acetylation
  MOD_RES (21)..(21): C-terminal amidation
GYASFYWFVQLHVHKRSWEMA

SEQ ID NO: 2495 - protein, 21 aa, Artificial Sequence
  Synthetic peptide
  MOD_RES (1)..(1): N-terminal acetylation
  MOD_RES (21)..(21): C-terminal amidation
GYASFPWFVQLYVHKRSWEMA

SEQ ID NO: 2496 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHYRSWEMA

SEQ ID NO: 2497 - protein, 21 aa, Artificial Sequence
  Synthetic peptide
  MOD_RES (1)..(1): N-terminal acetylation
  MOD_RES (21)..(21): C-terminal amidation
GYASFPWFVQLHVHKYSWEMA

SEQ ID NO: 2498 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGYASFPLAVQLHVSKRSKEMALARLYYKTS

SEQ ID NO: 2499-3000 - skipped (502 entries)

SEQ ID NO: 3001 - protein, 30 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  DISULFID (6)..(28): Cys residues linked via disfide bond
  MOD_RES (30)..(30): C-terminal amidation
XSGRGCTKVIVFTFRHNKLIGYERRYNCTS

SEQ ID NO: 3002 - protein, 30 aa, Artificial Sequence; identical to SEQ ID NO: 3001
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (30)..(30): C-terminal amidation

SEQ ID NO: 3003 - protein, 31 aa, Artificial Sequence
  Synthetic peptide
  MOD_RES (1)..(1): N-terminal acetylation
  MOD_RES (20)..(20): C-terminal amidation
  MOD_RES (30)..(30): Xaa is (13-Amino-4,7,10-trioxa-tridecayl)-succinamic acid
  MOD_RES (31)..(31): Linked to Biotin
SGRGCTKVIVFTFRHNKLIGYERRYNCTSXK

SEQ ID NO: 3004 - protein, 34 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (34)..(34): C-terminal amidation
XKKSGVWQTHPRYFWTMWPDIKGEVIVLFGTSKK

SEQ ID NO: 3005 - protein, 35 aa, Artificial Sequence
  Synthetic peptide
  MOD_RES (1)..(1): N-terminal acetylation
  MOD_RES (32)..(32): Xaa is (13-Amino-4,7,10-trioxa-tridecayl)-succinamic acid
  MOD_RES (35)..(35): Linked to Biotin
  MOD_RES (35)..(35): C-terminal amidation
KKSGVWQTHPRYFWTMWPDIKGEVIVLFGTSXKKK

SEQ ID NO: 3006 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGNTFVDERLLYFLTIGNMGMYAAQLKFRTS

SEQ ID NO: 3007 - protein, 13 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (13)..(13): C-terminal amidation
XLSLVGSFAVLCA

SEQ ID NO: 3008 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XGRGCTKVIVFTFRHNKLIGY

SEQ ID NO: 3009 - protein, 21 aa, Artificial Sequence
  Synthetic peptide
  MOD_RES (1)..(1): N-terminal Biotin
  MOD_RES (1)..(1): Xaa is (13-Amino-4,7,10-trioxa-tridecayl)-succinamic acid
  MOD_RES (21)..(21): C-terminal amidation
XCTKVIVFTFRHNKLIGYERR

SEQ ID NO: 3010 - protein, 21 aa, Artificial Sequence
  Synthetic peptide
  MOD_RES (1)..(1): N-terminal Biotin
  MOD_RES (1)..(1): Xaa is (13-Amino-4,7,10-trioxa-tridecayl)-succinamic acid
  MOD_RES (21)..(21): C-terminal amidation
XGCTKVIVFTFRHNKLIGYER

SEQ ID NO: 3011 - protein, 21 aa, Artificial Sequence
  Synthetic peptide
  MOD_RES (1)..(1): N-terminal Biotin
  MOD_RES (1)..(1): Xaa is (13-Amino-4,7,10-trioxa-tridecayl)-succinamic acid
  MOD_RES (21)..(21): C-terminal amidation
XVIVFTFRHNKLIGYERRYNC

SEQ ID NO: 3012 - protein, 19 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (19)..(19): C-terminal amidation
XYFLTIGNMGMYAAQLKFR

SEQ ID NO: 3013 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XYFLTIGNMGMYAAQLKFRTS

SEQ ID NO: 3014 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XLYFLTIGNMGMYAAQLKFRT

SEQ ID NO: 3015 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGQFWHGLLLPKGIVLNWTLKPWWMIGAFTS

SEQ ID NO: 3016 - protein, 33 aa, Artificial Sequence
  Synthetic peptide
  MOD_RES (1)..(1): N-terminal Biotinyl
  MOD_RES (32)..(32): Xaa is (13-Amino-4,7,10-trioxa-tridecayl)-succinamic acid
  MOD_RES (33)..(33): Linked to Biotin
  MOD_RES (33)..(33): C-terminal amidation
SGQFWHGLLLPKGIVLNWTLKPWWMIGAFTSXK

SEQ ID NO: 3017 - protein, 32 aa, Artificial Sequence
  Synthetic peptide
  MOD_RES (1)..(1): N-terminal acetylation
  MOD_RES (1)..(1): Xaa is (13-Amino-4,7,10-trioxa-tridecayl)-succinamic acid
  MOD_RES (32)..(32): C-terminal amidation
XSGRVSYYWGVKWSQQMPMSWWPDTWYTFDTS

SEQ ID NO: 3018 - protein, 33 aa, Artificial Sequence
  Synthetic peptide
  MOD_RES (1)..(1): N-terminal acetylation
  MOD_RES (32)..(32): Xaa is (13-Amino-4,7,10-trioxa-tridecayl)-succinamic acid
  MOD_RES (33)..(33): Linked to Biotin
  MOD_RES (33)..(33): C-terminal amidation
SGNTFVDERLLYFLTIGNMGMYAAQLKFRTSXK

SEQ ID NO: 3019 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGRFTTRLWYFSWDRLPWYMPFKQYVLSSTS

SEQ ID NO: 3020 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGSYQWWARPYRMWFGLPYWNQRVIFPWNTS

SEQ ID NO: 3021 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XLLYFLTIGNMGMYAAQLKFR

SEQ ID NO: 3022 - protein, 21 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (21)..(21): C-terminal amidation
XTKVIVFTFRHNKLIGYERRY

SEQ ID NO: 3023 - protein, 17 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (17)..(17): C-terminal amidation
XVIVFTFRHNKLIGYER

SEQ ID NO: 3024 - protein, 20 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (20)..(20): C-terminal amidation
FQRKGNVFVDGYFERLRAKL

SEQ ID NO: 3025 - protein, 31 aa, Artificial Sequence
  Synthetic peptide
  MOD_RES (1)..(1): N-terminal acetylation
  MOD_RES (31)..(31): C-terminal amidation
SGNTFVDERLLYFLTIGNMGMYAAQLKFRTS

SEQ ID NO: 3026 - protein, 23 aa, Artificial Sequence
  Synthetic peptide
  MOD_RES (1)..(1): N-terminal acetylation
  MOD_RES (23)..(23): C-terminal amidation
CTKVIVFTFRHNKLIGYERRYNC

SEQ ID NO: 3027 - protein, 30 aa, Artificial Sequence
  Synthetic peptide
  MOD_RES (1)..(1): N-terminal acetylation
  MOD_RES (30)..(30): C-terminal amidation
KKSGRGCTKVIVFTFRHNKLIGYERRYNKK

SEQ ID NO: 3028 - protein, 32 aa, Artificial Sequence
  Synthetic peptide
  MOD_RES (1)..(1): N-terminal acetylation
  MOD_RES (32)..(32): C-terminal amidation
KKSGVWQTHPRYFWTMWPDIKGEVIVLFGTKK

SEQ ID NO: 3029 - protein, 33 aa, Artificial Sequence
  Synthetic peptide
  MOD_RES (1)..(1): N-terminal acetylation
  MOD_RES (33)..(33): C-terminal amidation
KKSGRGCTKVIVFTFRHNKLIGYERRYNCTSKK

SEQ ID NO: 3030 - protein, 24 aa, Artificial Sequence
  Synthetic peptide
  MOD_RES (1)..(1): N-terminal acetylation
  MOD_RES (24)..(24): C-terminal amidation
KKVIVFTFRHNKLIGYERRYNCKK

SEQ ID NO: 3031 - protein, 35 aa, Artificial Sequence
  Synthetic peptide
  MOD_RES (1)..(1): N-terminal acetylation
  MOD_RES (35)..(35): C-terminal amidation
KKSGNTFVDERLLYFLTIGNMGMYAAQLKFRTSKK

SEQ ID NO: 3032 - protein, 30 aa, Artificial Sequence
  Synthetic peptide
  MOD_RES (1)..(1): N-terminal acetylation
  MOD_RES (30)..(30): C-terminal amidation
KKGCTKVIVFTFRHNKLIGYERRYNCTSKK

SEQ ID NO: 3033 - protein, 27 aa, Artificial Sequence
  Synthetic peptide
  MOD_RES (1)..(1): N-terminal acetylation
  MOD_RES (27)..(27): C-terminal amidation
KKKVIVFTFRHNKLIGYERRYNCTSKK

SEQ ID NO: 3034 - protein, 23 aa, Artificial Sequence
  Synthetic peptide
  MOD_RES (1)..(1): N-terminal acetylation
  MOD_RES (23)..(23): C-terminal amidation
VDERLLYFLTIGNMGMYAAQLKF

SEQ ID NO: 3035 - protein, 30 aa, Artificial Sequence
  Synthetic peptide
  MOD_RES (1)..(1): N-terminal acetylation
  MOD_RES (30)..(30): C-terminal amidation
KKGVWQTHPRYFWTMWPDIKGEVIVLFGKK

SEQ ID NO: 3036 - protein, 33 aa, Artificial Sequence
  Synthetic peptide
  MOD_RES (1)..(1): N-terminal acetylation
  MOD_RES (33)..(33): C-terminal amidation
KKSGVWQTHPRYFWTMWPDIKGEVIVLFGTSKK

SEQ ID NO: 3037 - protein, 32 aa, Artificial Sequence
  Synthetic peptide
  MOD_RES (1)..(1): N-terminal acetylation
  MOD_RES (32)..(32): C-terminal amidation
KKGVWQTHPRYFWTMWPDIKGEVIVLFGTSKK

SEQ ID NO: 3038 - protein, 25 aa, Artificial Sequence
  Synthetic peptide
  MOD_RES (1)..(1): N-terminal Carboxyfluorescein
  MOD_RES (25)..(25): C-terminal amidation
TFVDERLLYFLTIGNMGMYAAQLKF

SEQ ID NO: 3039 - protein, 24 aa, Artificial Sequence
  Synthetic peptide
  MOD_RES (1)..(1): N-terminal acetylation
  MOD_RES (24)..(24): C-terminal amidation
FVDERLLYFLTIGNMGMYAAQLKF

SEQ ID NO: 3040 - protein, 24 aa, Artificial Sequence
  Synthetic peptide
  MOD_RES (1)..(1): N-terminal acetylation
  MOD_RES (24)..(24): C-terminal amidation
TFVDERLLYFLTIGNMGMYAAQLK

SEQ ID NO: 3041 - protein, 26 aa, Artificial Sequence
  Synthetic peptide
  MOD_RES (1)..(1): N-terminal acetylation
  MOD_RES (26)..(26): C-terminal amidation
GCTKVIVFTFRHNKLIGYERRYNCTS

SEQ ID NO: 3042 - protein, 25 aa, Artificial Sequence
  Synthetic peptide
  MOD_RES (1)..(1): N-terminal acetylation
  MOD_RES (25)..(25): C-terminal amidation
CTKVIVFTFRHNKLIGYERRYNCTS

SEQ ID NO: 3043 - protein, 24 aa, Artificial Sequence
  Synthetic peptide
  MOD_RES (1)..(1): N-terminal acetylation
  MOD_RES (24)..(24): C-terminal amidation
TKVIVFTFRHNKLIGYERRYNCTS

SEQ ID NO: 3044 - protein, 25 aa, Artificial Sequence
  Synthetic peptide
  MOD_RES (1)..(1): N-terminal acetylation
  MOD_RES (25)..(25): C-terminal amidation
GCTKVIVFTFRHNKLIGYERRYNCT

SEQ ID NO: 3045 - protein, 24 aa, Artificial Sequence
  Synthetic peptide
  MOD_RES (1)..(1): N-terminal acetylation
  MOD_RES (24)..(24): C-terminal amidation
GCTKVIVFTFRHNKLIGYERRYNC

SEQ ID NO: 3046 - protein, 29 aa, Artificial Sequence
  Synthetic peptide
  MOD_RES (1)..(1): N-terminal acetylation
  MOD_RES (29)..(29): C-terminal amidation
KKGVWQTHPRYFWTMWPDIKGEVIVLFKK

SEQ ID NO: 3047 - protein, 29 aa, Artificial Sequence
  Synthetic peptide
  MOD_RES (1)..(1): N-terminal acetylation
  MOD_RES (29)..(29): C-terminal amidation
SGRGCTKVIVFTFRHNKLIGYERRYNCTS

SEQ ID NO: 3048 - protein, 23 aa, Artificial Sequence
  Synthetic peptide
  MOD_RES (1)..(1): N-terminal aceylation
  MOD_RES (23)..(23): C-terminal amidation
KKSGNTFVDERLLYFLTIGNMKK

SEQ ID NO: 3049 - protein, 29 aa, Artificial Sequence
  Synthetic peptide
  MOD_RES (1)..(1): N-terminal acetylation
  MOD_RES (29)..(29): C-terminal amidation
TNYTGSEKCIRFVTRRYLGVRINCFHKGS

SEQ ID NO: 3050 - protein, 29 aa, Artificial Sequence
  Synthetic peptide
  MOD_RES (1)..(1): N-terminal acetylation
  MOD_RES (29)..(29): C-terminal amidation
TRNVVRRYECFGSTGCIKYFIHSRTGLNK

SEQ ID NO: 3051 - protein, 27 aa, Artificial Sequence
  Synthetic peptide
  MOD_RES (1)..(1): N-terminal acetylation
  MOD_RES (27)..(27): C-terminal amidation
KKSGRGCTKVIVFTFRHNKLIGYERKK

SEQ ID NO: 3052 - protein, 24 aa, Artificial Sequence
  Synthetic peptide
  MOD_RES (1)..(1): N-terminal acetylation
  MOD_RES (24)..(24): C-terminal N-ethyl
KKGRGCTKVIVFTFRHNKLIGYKK

SEQ ID NO: 3053 - protein, 24 aa, Artificial Sequence
  Synthetic peptide
  MOD_RES (1)..(1): N-terminal acetylation
  MOD_RES (24)..(24): C-terminal amidation
KKCTKVIVFTFRHNKLIGYERRKK

SEQ ID NO: 3054 - protein, 30 aa, Artificial Sequence
  Synthetic peptide
  MOD_RES (1)..(1): N-terminal acetylation
  MOD_RES (30)..(30): C-terminal amidation
MLGVLMRGISALTGDYTARFEFYLNKQTFN

SEQ ID NO: 3055 - protein, 24 aa, Artificial Sequence
  Synthetic peptide
  MOD_RES (1)..(1): N-terminal acetylation
  MOD_RES (24)..(24): C-terminal amidation
KKGCTKVIVFTFRHNKLIGYERKK

SEQ ID NO: 3056 - protein, 33 aa, Artificial Sequence
  Synthetic peptide
  MOD_RES (1)..(1): N-terminal acetylation
  MOD_RES (33)..(33): C-terminal amidation
KKVGSVTRWSMYGPIFIKFTWTLEQPVGWDHKK

SEQ ID NO: 3057 - protein, 23 aa, Artificial Sequence
  Synthetic peptide
  MOD_RES (1)..(1): N-terminal acetylation
  MOD_RES (23)..(23): C-terminal amidation
KKFWTMWPDIKGEVIVLFGTSKK

SEQ ID NO: 3058 - protein, 24 aa, Artificial Sequence
  Synthetic peptide
  MOD_RES (1)..(1): N-terminal acetylation
  MOD_RES (24)..(24): C-terminal amidation
KKHPRYFWTMWPDIKGEVIVLFKK

SEQ ID NO: 3059 - protein, 24 aa, Artificial Sequence
  Synthetic peptide
  MOD_RES (1)..(1): N-terminal acetylation
  MOD_RES (24)..(24): C-terminal amidation
KKYFWTMWPDIKGEVIVLFGTSKK

SEQ ID NO: 3060 - protein, 24 aa, Artificial Sequence
  Synthetic peptide
  MOD_RES (1)..(1): N-terminal acetylation
  MOD_RES (24)..(24): C-terminal amidation
KKSGNTFVDERLLYFLTIGNMGKK

SEQ ID NO: 3061 - protein, 24 aa, Artificial Sequence
  Synthetic peptide
  MOD_RES (1)..(1): N-terminal acetylation
  MOD_RES (24)..(24): C-terminal amidation
KKSGRGCTKVIVFTFRHNKLIGKK

SEQ ID NO: 3062 - protein, 24 aa, Artificial Sequence
  Synthetic peptide
  MOD_RES (1)..(1): N-terminal acetylation
  MOD_RES (24)..(24): C-terminal amidation
KKTKVIVFTFRHNKLIGYERRYKK

SEQ ID NO: 3063 - protein, 24 aa, Artificial Sequence
  Synthetic peptide
  MOD_RES (1)..(1): N-terminal acetylation
  MOD_RES (24)..(24): C-terminal amidation
KKKVIVFTFRHNKLIGYERRYNKK

SEQ ID NO: 3064 - protein, 24 aa, Artificial Sequence
  Synthetic peptide
  MOD_RES (1)..(1): N-terminal acetylation
  MOD_RES (24)..(24): C-terminal amidation
KKIVFTFRHNKLIGYERRYNCTKK

SEQ ID NO: 3065 - protein, 33 aa, Artificial Sequence
  Synthetic peptide
  MOD_RES (1)..(1): N-terminal acetylation
  MOD_RES (33)..(33): C-terminal amidation
KKLTGDWTYFWSKVIWGPGVIERQMPVSTFHKK

SEQ ID NO: 3066 - protein, 29 aa, Artificial Sequence
  Synthetic peptide
  MOD_RES (1)..(1): N-terminal acetylation
  MOD_RES (29)..(29): C-terminal amidation
KKSGVWQTHPRYFWTMWPDIKGEVIVLKK

SEQ ID NO: 3067 - protein, 26 aa, Artificial Sequence
  Synthetic peptide
  MOD_RES (1)..(1): N-terminal acetylation
  MOD_RES (26)..(26): C-terminal amidation
KKSGVWQTHPRYFWTMWPDIKGEVKK

SEQ ID NO: 3068 - protein, 23 aa, Artificial Sequence
  Synthetic peptide
  MOD_RES (1)..(1): N-terminal acetylation
  MOD_RES (23)..(23): C-terminal amidation
KKSGVWQTHPRYFWTMWPDIKKK

SEQ ID NO: 3069 - protein, 29 aa, Artificial Sequence
  Synthetic peptide
  MOD_RES (1)..(1): N-terminal acetylation
  MOD_RES (29)..(29): C-terminal amidation
KKQTHPRYFWTMWPDIKGEVIVLFGTSKK

SEQ ID NO: 3070 - protein, 26 aa, Artificial Sequence
  Synthetic peptide
  MOD_RES (1)..(1): N-terminal acetylation
  MOD_RES (26)..(26): C-terminal amidation
KKPRYFWTMWPDIKGEVIVLFGTSKK

SEQ ID NO: 3071 - protein, 24 aa, Artificial Sequence
  Synthetic peptide
  MOD_RES (1)..(1): N-terminal acetylation
  MOD_RES (24)..(24): C-terminal amidation
KKSGVWQTHPRYFWTMWPDIKGKK

SEQ ID NO: 3072 - protein, 24 aa, Artificial Sequence
  Synthetic peptide
  MOD_RES (1)..(1): N-terminal acetylation
  MOD_RES (24)..(24): C-terminal amidation
KKWQTHPRYFWTMWPDIKGEVIKK

SEQ ID NO: 3073 - protein, 32 aa, Artificial Sequence
  Synthetic peptide
  MOD_RES (1)..(1): N-terminal acetylation
  MOD_RES (32)..(32): C-terminal amidation
KKSGNTFVDERLLYFLTIGNMGMYAAQLKFKK

SEQ ID NO: 3074 - protein, 29 aa, Artificial Sequence
  Synthetic peptide
  MOD_RES (1)..(1): N-terminal acetylation
  MOD_RES (29)..(29): C-terminal amidation
KKSGNTFVDERLLYFLTIGNMGMYAAQKK

SEQ ID NO: 3075 - protein, 26 aa, Artificial Sequence
  Synthetic peptide
  MOD_RES (1)..(1): N-terminal acetylation
  MOD_RES (26)..(26): C-terminal amidation
KKSGNTFVDERLLYFLTIGNMGMYKK

SEQ ID NO: 3076 - protein, 32 aa, Artificial Sequence
  Synthetic peptide
  MOD_RES (1)..(1): N-terminal acetylation
  MOD_RES (32)..(32): C-terminal amidation
KKTFVDERLLYFLTIGNMGMYAAQLKFRTSKK

SEQ ID NO: 3077 - protein, 29 aa, Artificial Sequence
  Synthetic peptide
  MOD_RES (1)..(1): N-terminal acetylation
  MOD_RES (29)..(29): C-terminal amidation
KKDERLLYFLTIGNMGMYAAQLKFRTSKK

SEQ ID NO: 3078 - protein, 26 aa, Artificial Sequence
  Synthetic peptide
  MOD_RES (1)..(1): N-terminal acetylation
  MOD_RES (26)..(26): C-terminal amidation
KKLLYFLTIGNMGMYAAQLKFRTSKK

SEQ ID NO: 3079 - protein, 23 aa, Artificial Sequence
  Synthetic peptide
  MOD_RES (1)..(1): N-terminal acetylation
  MOD_RES (23)..(23): C-terminal amidation
KKFLTIGNMGMYAAQLKFRTSKK

SEQ ID NO: 3080 - protein, 24 aa, Artificial Sequence
  Synthetic peptide
  MOD_RES (1)..(1): N-terminal acetylation
  MOD_RES (24)..(24): C-terminal amidation
KKLLYFLTIGNMGMYAAQLKFRKK

SEQ ID NO: 3081 - protein, 24 aa, Artificial Sequence
  Synthetic peptide
  MOD_RES (1)..(1): N-terminal acetylation
  MOD_RES (24)..(24): C-terminal amidation
KKLYFLTIGNMGMYAAQLKFRTKK

SEQ ID NO: 3082 - protein, 24 aa, Artificial Sequence
  Synthetic peptide
  MOD_RES (1)..(1): N-terminal acetylation
  MOD_RES (24)..(24): C-terminal amidation
KKYFLTIGNMGMYAAQLKFRTSKK

SEQ ID NO: 3083 - protein, 24 aa, Artificial Sequence
  Synthetic peptide
  MOD_RES (1)..(1): N-terminal acetylation
  MOD_RES (24)..(24): C-terminal amidation
KKVFTFRHNKLIGYERRYNCTSKK

SEQ ID NO: 3084 - protein, 22 aa, Artificial Sequence
  Synthetic peptide
  MOD_RES (1)..(1): N-terminal acetylation
  MOD_RES (22)..(22): C-terminal amidation
TFVDERLLYFLTIGNMGMYAAQ

SEQ ID NO: 3085 - protein, 31 aa, Artificial Sequence
  Synthetic peptide
  MOD_RES (1)..(1): N-terminal acetylation
  MOD_RES (31)..(31): C-terminal amidation
SGDTFVDERLLYFLTIGNMRMYAVQLKFRTS

SEQ ID NO: 3086 - protein, 31 aa, Artificial Sequence
  Synthetic peptide
  MOD_RES (1)..(1): N-terminal acetylation
  MOD_RES (31)..(31): C-terminal amidation
SGDTFVDERLLYFLTTGNMRMYAVQLKFRTS

SEQ ID NO: 3087 - protein, 31 aa, Artificial Sequence
  Synthetic peptide
  MOD_RES (1)..(1): N-terminal acetylation
  MOD_RES (31)..(31): C-terminal amidation
SGDTFVDERLLYFLTIGDMRMYAVQLKFRTS

SEQ ID NO: 3088 - protein, 31 aa, Artificial Sequence
  Synthetic peptide
  MOD_RES (1)..(1): N-terminal acetylation
  MOD_RES (31)..(31): C-terminal amidation
KKGVWQTHPRYFWTMWPDIKGEVIVLFGTKK

SEQ ID NO: 3089 - protein, 30 aa, Artificial Sequence
  Synthetic peptide
  MOD_RES (1)..(1): N-terminal acetylation
  MOD_RES (30)..(30): C-terminal amidation
KKVWQTHPRYFWTMWPDIKGEVIVLFGTKK

SEQ ID NO: 3090 - protein, 29 aa, Artificial Sequence
  Synthetic peptide
  MOD_RES (1)..(1): N-terminal acetylation
  MOD_RES (29)..(29): C-terminal amidation
KKWQTHPRYFWTMWPDIKGEVIVLFGTKK

SEQ ID NO: 3091 - protein, 31 aa, Artificial Sequence
  Synthetic peptide
  MOD_RES (1)..(1): N-terminal acetylation
  MOD_RES (31)..(31): C-terminal amidation
SGGRKHKHFLRSNGKPSRALCSMHFWRWSTS

SEQ ID NO: 3092 - protein, 32 aa, Artificial Sequence
  Synthetic peptide
  MOD_RES (1)..(1): N-terminal Biotinyl
  MOD_RES (1)..(1): Xaa is (13-Amino-4,7,10-trioxa-tridecayl)-succinamic acid
  MOD_RES (32)..(32): C-terminal amidation
XSGGRKHLHFLRSNGKPSRALCSMHFWRWSTS

SEQ ID NO: 3093 - protein, 31 aa, Artificial Sequence; identical to SEQ ID NO: 1293
  Synthetic peptide
  MOD_RES (1)..(1): N-terminal acetylation
  MOD_RES (31)..(31): C-terminal amidation

SEQ ID NO: 3094 - protein, 31 aa, Artificial Sequence
  Synthetic peptide
  MOD_RES (1)..(1): N-terminal acetylation
  MOD_RES (31)..(31): C-terminal amidation
KGSSRSGHNALKTHSWMSPFRRRGSWSLHFK

SEQ ID NO: 3095 - protein, 31 aa, Artificial Sequence
  Synthetic peptide
  MOD_RES (1)..(1): N-terminal acetylation
  MOD_RES (31)..(31): C-terminal amidation
KSRSGFWHAWSHRTRPMKSRLHLGKFSNSSG

SEQ ID NO: 3096 - protein, 28 aa, Artificial Sequence
  Synthetic peptide
  MOD_RES (1)..(1): N-terminal acetylation
  MOD_RES (28)..(28): C-terminal amidation
SGGRKHKHFLRSNGKPSRALSSMHFWRW

SEQ ID NO: 3097 - protein, 25 aa, Artificial Sequence
  Synthetic peptide
  MOD_RES (1)..(1): N-terminal acetylation
  MOD_RES (25)..(25): N-terminal amidation
SGGRKHKHFLRSNGKPSRALSSMHF

SEQ ID NO: 3098 - protein, 22 aa, Artificial Sequence
  Synthetic peptide
  MOD_RES (1)..(1): N-terminal acetylation
  MOD_RES (22)..(22): C-terminal amidation
SGGRKHKHFLRSNGKPSRALSS

SEQ ID NO: 3099 - protein, 19 aa, Artificial Sequence
  Synthetic peptide
  MOD_RES (1)..(1): N-terminal acetylation
  MOD_RES (19)..(19): C-terminal amidation
SGGRKHKHFLRSNGKPSRA

SEQ ID NO: 3100 - protein, 28 aa, Artificial Sequence
  Synthetic peptide
  MOD_RES (1)..(1): N-terminal acetylation
  MOD_RES (28)..(28): C-terminal amidation
RKHKHFLRSNGKPSRALSSMHFWRWSTS

SEQ ID NO: 3101 - protein, 25 aa, Artificial Sequence
  Synthetic peptide
  MOD_RES (1)..(1): N-terminal acetylation
  MOD_RES (25)..(25): C-terminal amidation
KHFLRSNGKPSRALSSMHFWRWSTS

SEQ ID NO: 3102 - protein, 22 aa, Artificial Sequence
  Synthetic peptide
  MOD_RES (1)..(1): N-terminal acetylation
  MOD_RES (22)..(22): C-terminal amidation
LRSNGKPSRALSSMHFWRWSTS

SEQ ID NO: 3103 - protein, 19 aa, Artificial Sequence
  Synthetic peptide
  MOD_RES (1)..(1): N-terminal acetylation
  MOD_RES (19)..(19): C-terminal amidation
NGKPSRALSSMHFWRWSTS

SEQ ID NO: 3104 - protein, 20 aa, Artificial Sequence
  Synthetic peptide
  MOD_RES (1)..(1): N-terminal acetylation
  MOD_RES (20)..(20): C-terminal amidation
SGGRKHKHFLRSNGKPSRAL

SEQ ID NO: 3105 - protein, 20 aa, Artificial Sequence
  Synthetic peptide
  MOD_RES (1)..(1): N-terminal acetylation
  MOD_RES (20)..(20): C-terminal amidation
RKHKHFLRSNGKPSRALSSM

SEQ ID NO: 3106 - protein, 20 aa, Artificial Sequence
  Synthetic peptide
  MOD_RES (1)..(1): N-terminal acetylation
  MOD_RES (20)..(20): C-terminal amidation
KHFLRSNGKPSRALSSMHFW

SEQ ID NO: 3107 - protein, 20 aa, Artificial Sequence
  Synthetic peptide
  MOD_RES (1)..(1): N-terminal acetylation
  MOD_RES (20)..(20): C-terminal amidation
LRSNGKPSRALSSMHFWRWS

SEQ ID NO: 3108 - protein, 20 aa, Artificial Sequence
  Synthetic peptide
SNGKPSRALSSMHFWRWSTS

SEQ ID NO: 3109 - protein, 15 aa, Artificial Sequence
  Synthetic peptide
  MOD_RES (1)..(1): Xaa is selected from the group consisting of Leu, Pro, Lys, Ser, Trp, Val, Asn, and Gln
  MOD_RES (2)..(2): Xaa is selected from the group consisting of Leu, Arg, Asn, Phe, and Ile
  MOD_RES (3)..(3): Xaa is selected from the group consisting of Tyr, Val, Pro, and Cys
  MOD_RES (4)..(4): Xaa is selected from the group consisting of Phe, Leu, Gly
  MOD_RES (5)..(5): Xaa is selected from the group consisting of Leu, Trp, Val, Ala, Met, Thr, and Ser
  MOD_RES (6)..(6): Xaa is selected from the group consisting of Thr, Phe, Val, Arg, Ala, Asp, Leu, Glu, Ser, and Tyr
  MOD_RES (7)..(7): Xaa is selected from the group consisting of Ile, Met, Gly, Gln, Asp, and Arg
  MOD_RES (8)..(8): Xaa is selected from the group consisting of Gly, Trp, Tyr, Leu, Met, and His
  MOD_RES (9)..(9): Xaa is selected from the group consisting of Asn, Pro, Phe, His, Lys, and Tyr
  MOD_RES (10)..(10): Xaa is selected from the group consisting of Met, Asp, Glu, Val, Gly, and Lys
  MOD_RES (11)..(11): Xaa is selected from the group consisting of Gly, Ile, Arg, Ser, Thr, and Leu
  MOD_RES (12)..(12): Xaa is selected from the group consisting of Met, Lys, Leu, and Ile
  MOD_RES (13)..(13): Xaa is selected from the group consisting of Tyr, Gly, Arg, and Ser
  MOD_RES (14)..(14): Xaa is selected from the group consisting of Ala, Glu, Ser, Cys, and Tyr
  MOD_RES (15)..(15): Xaa is selected from the group consisting of Ala, Val, Lys, and Glu
XXXXXXXXXXXXXXX

SEQ ID NO: 3110 - protein, 4 aa, Artificial Sequence
  Synthetic peptide
  MOD_RES (1)..(1): Xaa is selected from a group consisting of Val, Trp, Tyr, and Phe
  MOD_RES (2)..(2): Xaa is selected from a group consisting of Asp, Gln, and Ser
  MOD_RES (3)..(3): Xaa is selected from a group consisting of Glu, Thr, Asn, and Ser
  MOD_RES (4)..(4): Xaa is selected from a group consisting of Arg, His, Lys, and Ala
XXXX

SEQ ID NO: 3111 - protein, 5 aa, Artificial Sequence
  Synthetic peptide
  MOD_RES (1)..(1): Xaa is selected from a group consisting of Phe and Val
  MOD_RES (2)..(2): Xaa is selected from a group consisting of Val, Trp, Tyr, and Phe
  MOD_RES (3)..(3): Xaa is selected from a group consisting of Asp, Gln, and Ser
  MOD_RES (4)..(4): Xaa is selected from a group consisting of Glu, Thr, Asn, and Ser
  MOD_RES (5)..(5): Xaa is selected from a group consisting of Arg, His, Lys, and Ala
XXXXX

SEQ ID NO: 3112 - protein, 6 aa, Artificial Sequence
  Synthetic peptide
  MOD_RES (1)..(1): Xaa is selected from a group consisting of Thr and Gly
  MOD_RES (2)..(2): Xaa is selected from a group consisting of Phe and Val
  MOD_RES (3)..(3): Xaa is selected from a group consisting of Val, Trp, Tyr, and Phe
  MOD_RES (4)..(4): Xaa is selected from a group consisting of Asp, Gln, and Ser
  MOD_RES (5)..(5): Xaa is selected from a group consisting of Glu, Thr, Asn, and Ser
  MOD_RES (6)..(6): Xaa is selected from a group consisting of Arg, His, Lys, and Ala
XXXXXX

SEQ ID NO: 3113 - protein, 4 aa, Artificial Sequence
  Synthetic peptide
  MOD_RES (1)..(1): Xaa is selected from a group consisting of Gln, Ile, Glu, Trp, Arg, Leu, and Asn
  MOD_RES (2)..(2): Xaa is selected from a group consisting of Leu, Val, Met, and Arg
  MOD_RES (3)..(3): Xaa is selected from a group consisting of Lys, Leu, Ala, and Tyr
XXXF

SEQ ID NO: 3114 - protein, 5 aa, Artificial Sequence
  Synthetic peptide
  MOD_RES (1)..(1): Xaa is selected from a group consisting of Gln, Ile, Glu, Trp, Arg, Leu, and Asn
  MOD_RES (2)..(2): Xaa is selected from a group consisting of Leu, Val, Met, and Arg
  MOD_RES (3)..(3): Xaa is selected from a group consisting of Lys, Leu, Ala, and Tyr
XXXPG

SEQ ID NO: 3115 - protein, 6 aa, Artificial Sequence
  Synthetic peptide
  MOD_RES (1)..(1): Xaa is selected from a group consisting of Gln, Ile, Glu, Trp, Arg, Leu, and Asn
  MOD_RES (2)..(2): Xaa is selected from a group consisting of Leu, Val, Met, and Arg
  MOD_RES (3)..(3): Xaa is selected from a group consisting of Lys, Leu, Ala, and Tyr
XXXPGT

SEQ ID NO: 3116 - protein, 20 aa, Artificial Sequence
  Synthetic peptide
  MOD_RES (1)..(1): Xaa is an amino acid selected from the group consisting of Bhf, Cys, Asp, Phe, Gly, His, Ile, Lys, Leu, Met, Asn, Nmf, Gln, Arg, Thr, Val, Trp and Tyr
  MOD_RES (2)..(2): Xaa is an amino acid selected from the group consisting Gly, Lys, and Gln
  MOD_RES (3)..(3): Xaa is an amino acid selected from the group consisting Ala, Aib, Bhs, Cys, Asp, Glu, Phe, Gly, His, Ile, Lys, Leu, Met, Asn, Pro, Gln, Arg, Ser, Thr, Val, Trp and Tyr
  MOD_RES (4)..(4): Xaa is an amino acid selected from the group consisting Ala, Aib, Bhk, Cys, Asp, Glu, Phe, Gly, His, Ile, Lys, D-Lys, Leu, Met, Asn, Nmk, Pro, Gln, Arg, Ser, Thr, Val, Trp and Tyr
  MOD_RES (5)..(5): Xaa is an amino acid selected from the group consisting D-Ala, Ala, Aib, Bal, Cys, Asp, D-Asp, Glu, Phe, Gly, His, Lys, D-Lys, Leu, Met, Asn, Nmg, D-Pro, Gln, Arg, Ser, Thr, Val, Trp and Tyr
  MOD_RES (6)..(6): Xaa is an amino acid selected from the group consisting Ala, Aib, Btq, Cys, Asp, Glu, Phe, Gly, His, Ile, Lys, Leu, Met, Asn, Gln, Arg, Ser, Thr, Val, Trp and Tyr
  MOD_RES (7)..(7): Xaa is an amino acid selected from the group consisting Ala, Phe, Gly, Ile, Lys, Leu, Nmv, Pro, Gln, Ser, Val, Trp and Tyr
  MOD_RES (8)..(8): Xaa is an amino acid selected from the group consisting Phe, His, Lys, Trp and Tyr
  MOD_RES (9)..(9): Xaa is an amino acid selected from the group consisting Ala, Aib, D-Phe, Ile, Lys, Ser, Thr, and Val
  MOD_RES (10)..(10): Xaa is an amino acid selected from the group consisting Ala, Aib, Cys, Asp, Glu, Phe, Gly, His, Ile, Lys, Leu, Met, Asn, Nmf, Pro, Gln, Arg, Ser, Thr, Val, Trp and Tyr
  MOD_RES (11)..(11): Xaa is an amino acid selected from the group consisting Aib, Cys, Lys, Gly, and Nmg
  MOD_RES (13)..(13): Xaa is an amino acid selected from the group consisting Ala, Aib, Cys, Glu, Phe, Gly, His, Lys, Leu, Met, Gln, Arg, Trp, and Tyr
  MOD_RES (14)..(14): Xaa is an amino acid selected from the group consisting Ala, Aib, Bhe, Cys, Asp, Glu, Phe, Gly, His, Ile, Lys, Leu, Met, Asn, Pro, Gln, Arg, Ser, Thr, Val, Trp, and Tyr
  MOD_RES (15)..(15): Xaa is an amino acid selected from the group consisting (omega-methyl)-Arg, Asp, Glu, Lys and Arg
  MOD_RES (17)..(17): Xaa is an amino acid selected from the group consisting (omega-methyl)-Arg, Ala, Aib, Bhr, Cys, Cha, Cit, Asp, Dab, Dap, Glu, Eag, Eew, Phe, Gly, His, Har, Hci, Hle, Ile, Lys, Leu, Met, Asn, Nle, Nva, Opa, Orn, Gln, Arg, Ser, Thr, Val, Trp and Tyr
  MOD_RES (18)..(18): Xaa is an amino acid selected from the group consisting Ala, Bal, Cys, Asp, Glu, Phe, Gly, His, Ile, Lys, Leu, Met, Asn, Gln, Arg, Ser, Thr, Val, Trp and Tyr
  MOD_RES (19)..(19): Xaa is an amino acid selected from the group consisting Bhk, Lys, Arg, and Val
  MOD_RES (20)..(20): Xaa is an amino acid selected from the group consisting of Aib, Bhl, Cys, Phe, Gly, His, Ile, Lys, Leu, Nml, Gln, Arg, Ser, Thr, Val, Trp and Tyr or is absent
XXXXXXXXXXXYXXXLXXXX

SEQ ID NO: 3117 - protein, 20 aa, Artificial Sequence
  Synthetic peptide
  MOD_RES (1)..(1): Xaa is selected from any amino acid
  MOD_RES (3)..(3): Xaa is selected from any amino acid
  MOD_RES (4)..(4): Xaa is selected from any amino acid
  MOD_RES (5)..(5): Xaa is selected from any amino acid
  MOD_RES (6)..(6): Xaa is selected from any amino acid
  MOD_RES (7)..(7): Xaa is an amino acid selected from the group consisting of Ile and Val
  MOD_RES (8)..(8): Xaa is selected from any amino acid
  MOD_RES (10)..(10): Xaa is selected from any amino acid
  MOD_RES (13)..(13): Xaa is an amino acid selected from the group consisting of Cys and Phe
  MOD_RES (14)..(14): Xaa is selected from any amino acid
  MOD_RES (17)..(17): Xaa is selected from any amino acid
  MOD_RES (18)..(18): Xaa is selected from any amino acid
  MOD_RES (20)..(20): Xaa is an amino acid selected from the group consisting of Lys and Leu
XQXXXXXXVXGYXXRLXXKX

SEQ ID NO: 3118 - protein, 23 aa, Artificial Sequence
  Synthetic peptide
  MOD_RES (1)..(1): Xaa is an amino acid selected from a group consisting of Ala, Asp, Glu, Phe, Gly, His, Ile, Lys, Leu, Pro, Arg, Ser, Thr, Val and Trp or is absent
  MOD_RES (2)..(2): Xaa is an amino acid selected from a group consisting of Ala, Asp, Glu, Phe, Gly, His, Ile, Lys, Leu, Met, Pro, Arg, Ser, Thr, Val and Trp or is absent
  misc_feature (3)..(3): Xaa can be any naturally occurring amino acid
  MOD_RES (4)..(4): Xaa is an amino acid selected from a group consisting of Ala, Asp, Glu, Phe, Gly, Ile, Lys, Leu, Arg, Ser, Thr, Val and Trp
  MOD_RES (6)..(6): Xaa is an amino acid selected from a group consisting of Phe, His, Ile, Lys, Leu, Arg, Val and Trp
  MOD_RES (7)..(7): Xaa is an amino acid selected from a group consisting of Cys, Hcy, Dap and Lys, preferably selected from the group consisting of Cys and Hcy
  DISULFID (7)..(18): Cys residues linked via disulfide bond
  MOD_RES (8)..(8): Xaa is an amino acid selected from a group consisting of Ala, Gly, Arg, Ser and Thr
  MOD_RES (9)..(9): Xaa is an amino acid selected from a group consisting of Ala, Ile, Lys, Leu, Met, D-Met, Nle, D-Pro, Arg, and Val
  MOD_RES (10)..(10): Xaa is an amino acid selected from a group consisting of Ala, Gly, Ile, Lys, Leu, Pro, Arg, Ser, Thr and Val
  MOD_RES (11)..(11): Xaa is an amino acid selected from a group consisting of Asp, Glu, Gly, Ser and Thr
  MOD_RES (12)..(12): Xaa is an amino acid selected from a group consisting of Ala, D-Ala, Asp, D-Asp, Glu, D-Glu, Phe, D-Phe, Gly, Ile, Lys, D-Lys, Leu, D-Leul, Met, D-Met, Nle, D-Nle, Pro, D-Pro, Arg, D-Arg, Ser, D-Ser, Thr, D-Thr, Val, D-Val, Trp and D-Trp
  MOD_RES (13)..(13): Xaa is an amino acid selected from a group consisting of Ala, Asp, D-Asp, Glu, D-Glu, Phe, Gly, Ile, Lys, Leu, Arg, Ser, D-Ser, Thr, Val and Trp
  MOD_RES (15)..(15): Xaa is an amino acid selected from a group consisting of Ala, Asp, Glu, Phe, Gly, Ile, Lys, Leu, Met,  Nle,  Arg, Ser, Thr, Val and Trp
  MOD_RES (16)..(16): Xaa is an amino acid selected from a group consisting of Ala, Asp, Glu, Phe, Ile, Lys, Leu, Met, Nle,  Arg, Ser, Thr, Val, Trp and Tyr
  MOD_RES (17)..(17): Xaa is an amino acid selected from a group consisting of Ala, Asp, Glu, Phe, Gly, Ile, Lys, Leu, Arg, Ser, Thr, Val, Trp and Tyr
  MOD_RES (18)..(18): Xaa is an amino acid selected from a group consisting of Cys and Asp
  MOD_RES (19)..(19): Xaa is an amino acid selected from a group consisting of Ala, Phe, Ile, Leu, Ser, Thr, Val, and Trp
  MOD_RES (20)..(20): Xaa is an amino acid selected from a group consisting of Phe and Trp
  MOD_RES (21)..(21): Xaa is an amino acid selected from a group consisting of Ile, Leu, and Val
  MOD_RES (22)..(22): Xaa is an amino acid selected from a group consisting of Ala, Asp, Glu, Phe, Gly, Ile, Lys, Leu, Pro, Arg, Ser, Thr, Val, and Trp
  MOD_RES (23)..(23): Xaa is an amino acid selected from a group consisting of Ala, Asp, Glu, Phe, Gly, Ile, Lys, Leu, Arg, Ser, Thr, Val, Trp and Tyr or is absent
XXXXWXXXXXXXXXXXXXXXXXX

SEQ ID NO: 3119 - protein, 23 aa, Artificial Sequence
  Synthetic peptide
  MOD_RES (1)..(1): Xaa is selected from any amino acid or is absent
  MOD_RES (2)..(2): Xaa is selected from any amino acid or is absent
  MOD_RES (3)..(3): Xaa is selected a group of amino acids consisting of Phe and Tyr
  MOD_RES (6)..(6): Xaa is selected a group of amino acids consisting of Phe and His
  DISULFID (7)..(18): Cys residues linked via disulfide bond
  MOD_RES (8)..(8): Xaa is selected from any amino acid
  MOD_RES (9)..(9): Xaa is selected a group of amino acids consisting of Met and Val
  MOD_RES (10)..(10): Xaa is selected from any amino acid
  MOD_RES (12)..(12): Xaa is selected from any amino acid
  MOD_RES (13)..(13): Xaa is selected from any amino acid
  MOD_RES (15)..(15): Xaa is selected a group of amino acids consisting of Ile and Thr
  MOD_RES (16)..(16): Xaa is selected from any amino acid
  MOD_RES (17)..(17): Xaa is selected a group of amino acids consisting of Ser and Thr
  MOD_RES (19)..(19): Xaa is selected a group of amino acids consisting of Ala and Val
  MOD_RES (22)..(22): Xaa is selected from any amino acid
  MOD_RES (23)..(23): Xaa is selected from any amino acid or is absent
XXXKWXCXXXDXXGXXXCXWVXX

SEQ ID NO: 3120 - protein, 21 aa, Artificial Sequence
  Synthetic peptide
  MOD_RES (1)..(1): Xaa is an amino acid selected from the group consisting of Ala, Cys, Asp, Phe, Gly, Ile, Lys, Leu, Met, Asn, Pro, Gln, Arg, Ser, Thr, Trp, Glu, His and Tyr or is absent
  MOD_RES (2)..(2): Xaa is an amino acid selected from the group consisting of Ala, Cys, Asp, Phe, His, Lys, Met, Asn, Pro, Arg, Ser, Thr, Trp, Tyr, Gly, Ile, and Leu or is absent
  MOD_RES (3)..(3): Xaa is an amino acid selected from the group consisting of Ala, Cys, Asp, Glu, Phe, Gly, His, Ile, Lys, Met, Asn, Pro, Arg, Ser, Thr, Trp, and Tyr
  MOD_RES (4)..(4): Xaa is an amino acid selected from the group consisting of Ala, Cys, Asp, Glu, Phe, Gly, His, Ile, Lys, Leu, Met, Asn, Gln, Arg, Ser, Thr, Val, Trp, Tyr and Pro
  MOD_RES (5)..(5): Xaa is an amino acid selected from the group consisting of Cys, Asp, Phe, Gly, His, Ile, Lys, Leu, Met, Asn, Pro, Arg, Ser, Thr, Val, Trp, and Tyr
  MOD_RES (6)..(6): Xaa is an amino acid selected from the group consisting of Ala, Trp, Cys, Lys, Pro, Arg, and His
  MOD_RES (7)..(7): Xaa is an amino acid selected from the group consisting of Gln, Ala, Cys, Phe, Gly, His, Ile, Lys, Leu, Asn, Arg, Thr, Trp and Tyr
  MOD_RES (8)..(8): Xaa is an amino acid selected from the group consisting of Ala, Cys, Phe, Gly, His, Lys, Leu, Met, Asn, Pro, Gln, Arg, Ser, Thr, Val, Trp, Tyr and Ile
  MOD_RES (9)..(9): Xaa is an amino acid selected from the group consisting of Ala, Cys, Phe, Gly, His, Ile, Leu, Met, Arg, Ser, Thr, Val, Trp, Tyr and Lys
  MOD_RES (10)..(10): Xaa is an amino acid selected from the group consisting of Ala, Cys, Phe, Gly, His, Ile, Lys,  Leu, Met, Asn, Pro, Gln, Arg, Ser, Thr, Val, Trp, and Tyr
  MOD_RES (11)..(11): Xaa is an amino acid selected from the group consisting of Ala, Gly, Ile, Lys, Leu, Met, Asn, Gln, Arg, Ser, Thr, Val, Trp, Tyr, Cys, Phe, and His
  MOD_RES (12)..(12): Xaa is an amino acid selected from the group consisting of Ala, Cys, His, Ile, Lys, Leu, and Arg
  MOD_RES (13)..(13): Xaa is an amino acid selected from the group consisting of Ala, Cys, Phe, Gly, His, Lys, Leu, Met, Arg, Ser, Val, Trp, Tyr, and Ile
  MOD_RES (14)..(14): Xaa is an amino acid selected from the group consisting of Ala, Cys, Phe, Gly, His, Ile, Leu, Met, Asn, Gln, Arg, Ser, Thr, Val, Trp, Tyr, and Lys
  MOD_RES (15)..(15): Xaa is an amino acid selected from the group consisting of Ala, Lys, and Arg
  MOD_RES (16)..(16): Xaa is an amino acid selected from the group consisting of Ala, Phe, Lys, and Arg
  MOD_RES (17)..(17): Xaa is an amino acid selected from the group consisting of Ala, Cys, Phe, Gly, Ile, Lys, Leu, Asn, Gln, Arg, Ser, Thr, Val, Trp, Tyr, His, and Met
  MOD_RES (18)..(18): Xaa is an amino acid selected from the group consisting of Ala, Cys, Phe, Ile, Lys, Leu, Met, Gln, Arg, Val, Trp, and Tyr
  MOD_RES (19)..(19): Xaa is an amino acid selected from the group consisting of Ala, Cys, Asp, Glu, Phe, Gly, His, Lys, Leu, Asn, Pro, Gln, Arg, Val, Trp, Tyr, and Ile
  MOD_RES (20)..(20): Xaa is an amino acid selected from the group consisting of Ala, Cys, Phe, Gly, His, Lys, Leu, Met, Asn, Gln, Arg, Val, Trp, Tyr, Ile, and Pro
  MOD_RES (21)..(21): Xaa is an amino acid selected from the group consisting of Ala, Cys, His, Ile, Lys, Leu, Met, Pro,  Arg, Thr, Val, Trp, Tyr, Phe, and Gly
XXXXXXXXXXXXXXXXXXXXX

SEQ ID NO: 3121 - protein, 21 aa, Artificial Sequence
  Synthetic peptide
  MOD_RES (1)..(1): Xaa is selected from any amino acid or is absent
  MOD_RES (2)..(2): Xaa is selected from any amino acid or is absent
  MOD_RES (3)..(3): Xaa is selected from any amino acid
  MOD_RES (4)..(4): Xaa is selected from any amino acid
  MOD_RES (5)..(5): Xaa is selected from any amino acid
  MOD_RES (6)..(6): Xaa is selected from any amino acid
  MOD_RES (7)..(7): Xaa is selected from any amino acid
  MOD_RES (8)..(8): Xaa is selected from any amino acid
  MOD_RES (9)..(9): Xaa is selected from any amino acid
  MOD_RES (10)..(10): Xaa is selected from any amino acid
  MOD_RES (11)..(11): Xaa is selected from any amino acid
  MOD_RES (13)..(13): Xaa is selected from any amino acid
  MOD_RES (14)..(14): Xaa is selected from any amino acid
  MOD_RES (15)..(15): Xaa is an amino acid selected from a group consisting of Lys and Arg
  MOD_RES (17)..(17): Xaa is selected from any amino acid
  MOD_RES (18)..(18): Xaa is selected from any amino acid
  MOD_RES (19)..(19): Xaa is selected from any amino acid
  MOD_RES (20)..(20): Xaa is selected from any amino acid
  MOD_RES (21)..(21): Xaa is selected from any amino acid
XXXXXXXXXXXHXXXRXXXXX

SEQ ID NO: 3122 - protein, 20 aa, Artificial Sequence
  Synthetic peptide
  MOD_RES (1)..(1): Xaa is an amino acid selected from the group consisting of Ala, Glu, and Pro or is absent
  MOD_RES (2)..(2): Xaa is an amino acid selected from the group consisting of Phe, Leu, Tyr, and Met
  MOD_RES (4)..(4): Xaa is an amino acid selected from the group consisting of Met, Gln, Arg, Ser, Thr, and Cys
  MOD_RES (5)..(5): Xaa is an amino acid selected from the group consisting of Aib, Lys, Pro, Arg, Glu, Ile, Tyr, Met, and Trp
  MOD_RES (6)..(6): Xaa is an amino acid selected from the group consisting of D-Ala, Aib, Asp, D-Asp, Gly, His, Lys, D-Lys, Asn, Nmg, D-Pro, Gln, Arg, Ala, Glu, Cys, and Met
  MOD_RES (7)..(7): Xaa is an amino acid selected from the group consisting of Ala, Cys, Asp, Gly, His, Lys, Asn, Gln, Arg, Ser, and Met
  MOD_RES (8)..(8): Xaa is an amino acid selected from the group consisting of Ile and Val
  MOD_RES (9)..(9): Xaa is an amino acid selected from the group consisting of Phe, His, and Tyr
  MOD_RES (11)..(11): Xaa is an amino acid selected from the group consisting of Ala, Asp, Glu, Lys, Met, Asn, Gln, Arg, Phe, His Pro, Ser, Val Trp
  MOD_RES (14)..(14): Xaa is an amino acid selected from the group consisting of Cys and Phe
  MOD_RES (15)..(15): Xaa is an amino acid selected from the group consisting of Ala, Cys, Asp, Glu, Lys, Leu, Met Asn, Gln, Arg, Thr, Val and Aib
  MOD_RES (18)..(18): Xaa is an amino acid selected from the group consisting of Ala, Aib, Cys, Cha, Dab, Dap, Eag, Eew, His, Har, Hci, Hle, Lys, Nle, Nva, Opa, Orn, Arg, Ile, Leu, Ser, and Met
  MOD_RES (19)..(19): Xaa is an amino acid selected from the group consisting of Ala, Leu, Asn, Met, and Arg
  MOD_RES (20)..(20): Xaa is an amino acid selected from the group consisting of Lys and Leu
XXQXXXXXXVXGYXXRLXKX

SEQ ID NO: 3123 - protein, 4 aa, Artificial Sequence
  Synthetic peptide
  MOD_RES (1)..(1): Xaa is Leu or Lys
  MOD_RES (2)..(2): Xaa is Gln or Lys
  MOD_RES (3)..(3): Xaa is Val or Lys
  MOD_RES (4)..(4): Xaa is Ala or Lys
XXXX

SEQ ID NO: 3124 - protein, 5 aa, Artificial Sequence
  Synthetic peptide
  MOD_RES (1)..(1): Xaa is Arg or Lys
  MOD_RES (2)..(2): Xaa is Leu or Lys
  MOD_RES (3)..(3): Xaa is Gln or Lys
  MOD_RES (4)..(4): Xaa is Val or Lys
  MOD_RES (5)..(5): Xaa is Ala or Lys
XXXXX

SEQ ID NO: 3125 - protein, 6 aa, Artificial Sequence
  Synthetic peptide
  MOD_RES (1)..(1): Xaa is Gly or Lys
  MOD_RES (2)..(2): Xaa is Arg or Lys
  MOD_RES (3)..(3): Xaa is Leu or Lys
  MOD_RES (4)..(4): Xaa is Gln or Lys
  MOD_RES (5)..(5): Xaa is Val or Lys
  MOD_RES (6)..(6): Xaa is Ala or Lys
XXXXXX

SEQ ID NO: 3126 - protein, 7 aa, Artificial Sequence
  Synthetic peptide
  MOD_RES (1)..(1): Xaa is Val or Lys
  MOD_RES (2)..(2): Xaa is Gly or Lys
  MOD_RES (3)..(3): Xaa is Arg or Lys
  MOD_RES (4)..(4): Xaa is Leu or Lys
  MOD_RES (5)..(5): Xaa is Gln or Lys
  MOD_RES (6)..(6): Xaa is Val or Lys
  MOD_RES (7)..(7): Xaa is Ala or Lys
XXXXXXX

SEQ ID NO: 3127 - protein, 8 aa, Artificial Sequence
  Synthetic peptide
  MOD_RES (1)..(1): Xaa is Gly or Lys
  MOD_RES (2)..(2): Xaa is Val or Lys
  MOD_RES (3)..(3): Xaa is Gly or Lys
  MOD_RES (4)..(4): Xaa is Arg or Lys
  MOD_RES (5)..(5): Xaa is Leu or Lys
  MOD_RES (6)..(6): Xaa is Gln or Lys
  MOD_RES (7)..(7): Xaa is Val or Lys
  MOD_RES (8)..(8): Xaa is Ala or Lys
XXXXXXXX

SEQ ID NO: 3128 - protein, 9 aa, Artificial Sequence
  Synthetic peptide
  MOD_RES (1)..(1): Xaa is Ser or Lys
  MOD_RES (2)..(2): Xaa is Gly or Lys
  MOD_RES (3)..(3): Xaa is Val or Lys
  MOD_RES (4)..(4): Xaa is Gly or Lys
  MOD_RES (5)..(5): Xaa is Arg or Lys
  MOD_RES (6)..(6): Xaa is Leu or Lys
  MOD_RES (7)..(7): Xaa is Gln or Lys
  MOD_RES (8)..(8): Xaa is Val or Lys
  MOD_RES (9)..(9): Xaa is Ala or Lys
XXXXXXXXX

SEQ ID NO: 3129 - protein, 10 aa, Artificial Sequence
  Synthetic peptide
  MOD_RES (2)..(2): Xaa is Ser or Lys
  MOD_RES (3)..(3): Xaa is Gly or Lys
  MOD_RES (4)..(4): Xaa is Val or Lys
  MOD_RES (5)..(5): Xaa is Gly or Lys
  MOD_RES (6)..(6): Xaa is Arg or Lys
  MOD_RES (7)..(7): Xaa is Leu or Lys
  MOD_RES (8)..(8): Xaa is Gln or Lys
  MOD_RES (9)..(9): Xaa is Val or Lys
  MOD_RES (10)..(10): Xaa is Ala or Lys
KXXXXXXXXX

SEQ ID NO: 3130 - protein, 11 aa, Artificial Sequence
  Synthetic peptide
  MOD_RES (3)..(3): Xaa is Ser or Lys
  MOD_RES (4)..(4): Xaa is Gly or Lys
  MOD_RES (5)..(5): Xaa is Val or Lys
  MOD_RES (6)..(6): Xaa is Gly or Lys
  MOD_RES (7)..(7): Xaa is Arg or Lys
  MOD_RES (8)..(8): Xaa is Leu or Lys
  MOD_RES (9)..(9): Xaa is Gln or Lys
  MOD_RES (10)..(10): Xaa is Val or Lys
  MOD_RES (11)..(11): Xaa is Ala or Lys
KKXXXXXXXXX

SEQ ID NO: 3131 - protein, 4 aa, Artificial Sequence
  Synthetic peptide
  MOD_RES (1)..(1): Xaa is Tyr or Lys
  MOD_RES (2)..(2): Xaa is Ser or Lys
XXKK

SEQ ID NO: 3132 - protein, 31 aa, Artificial Sequence; identical to SEQ ID NO: 3094
  Synthetic peptide
  MOD_RES (1)..(1): N-terminal acetylation
  MOD_RES (31)..(31): C-terminal amidation

SEQ ID NO: 3133 - protein, 31 aa, Artificial Sequence; identical to SEQ ID NO: 3095
  Synthetic peptide
  MOD_RES (1)..(1): N-terminal acetylation
  MOD_RES (1)..(1): N-terminal acetylation
  MOD_RES (31)..(31): C-terminal amidation

SEQ ID NO: 3134 - protein, 28 aa, Artificial Sequence
  Synthetic peptide
  MOD_RES (1)..(1): N-terminal acetylation
  MOD_RES (28)..(28): C-terminal amidation
SGGRKHKHFLRSNGKPSRALSSMHFWRW

SEQ ID NO: 3135 - protein, 25 aa, Artificial Sequence
  Synthetic peptide
  MOD_RES (1)..(1): N-terminal acetylation
  MOD_RES (25)..(25): C-terminal amidation
SGGRKHKHFLRSNGKPSRALSSMHF

SEQ ID NO: 3136 - protein, 22 aa, Artificial Sequence
  Synthetic peptide
  MOD_RES (1)..(1): N-terminal acetylation
  MOD_RES (22)..(22): C-terminal amidation
SGGRKHKHFLRSNGKPSRALSS

SEQ ID NO: 3137 - protein, 19 aa, Artificial Sequence
  Synthetic peptide
  MOD_RES (1)..(1): N-terminal acetylation
  MOD_RES (19)..(19): C-terminal amidation
SGGRKHKHFLRSNGKPSRA

SEQ ID NO: 3138 - protein, 28 aa, Artificial Sequence
  Synthetic peptide
RKHKHFLRSNGKPSRALSSMHFWRWSTS

SEQ ID NO: 3139 - protein, 25 aa, Artificial Sequence
  Synthetic peptide
  MOD_RES (1)..(1): N-terminal acetylation
  MOD_RES (25)..(25): C-terminal amidation
KHFLRSNGKPSRALSSMHFWRWSTS

SEQ ID NO: 3140 - protein, 22 aa, Artificial Sequence
  Synthetic peptide
  MOD_RES (1)..(1): N-terminal acetylation
  MOD_RES (22)..(22): C-terminal amidation
LRSNGKPSRALSSMHFWRWSTS

SEQ ID NO: 3141 - protein, 19 aa, Artificial Sequence
  Synthetic peptide
  MOD_RES (1)..(1): N-terminal acetylation
  MOD_RES (19)..(19): C-terminal amidation
NGKPSRALSSMHFWRWSTS

SEQ ID NO: 3142 - protein, 20 aa, Artificial Sequence
  Synthetic peptide
  MOD_RES (1)..(1): N-terminal acetylation
  MOD_RES (20)..(20): C-terminal amidation
SGGRKHKHFLRSNGKPSRAL

SEQ ID NO: 3143 - protein, 20 aa, Artificial Sequence
  Synthetic peptide
  MOD_RES (1)..(1): N-terminal acetylation
  MOD_RES (20)..(20): C-terminal amidation
RKHKHFLRSNGKPSRALSSM

SEQ ID NO: 3144 - protein, 20 aa, Artificial Sequence
  Synthetic peptide
  MOD_RES (1)..(1): N-terminal acetylation
  MOD_RES (20)..(20): C-terminal amidation
KHFLRSNGKPSRALSSMHFW

SEQ ID NO: 3145 - protein, 20 aa, Artificial Sequence
  Synthetic peptide
  MOD_RES (1)..(1): N-terminal acetylation
  MOD_RES (20)..(20): C-terminal amidation
SNGKPSRALSSMHFWRWSTS

SEQ ID NO: 3146 - protein, 123 aa, Homo sapiens
FCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNIC

SEQ ID NO: 3147 - protein, 123 aa, Macaca mulatta
FCAFKPDDGPCKAIMKRFFFNIFTRQCEEFIYGGCGGNQNRFESMEECKKVCTRDNVHRIIQTALQQEKPDFCFLEEDPGICRGYITRYFYNNQSKQCERFKYGGCLGNMNNFETLEECKNTC

SEQ ID NO: 3148 - protein, 123 aa, Oryctolagus cuniculus
FCAMKVDDGPCRAYIKRFFFNILAHQCEEFIYGGCEGNENRFESLEECKEKCARDYPKMTTKLTFQKGKPDFCFLEEDPGICRGYITRYFYNNQSKQCERFKYGGCLGNLNNFESLEECKNTC

SEQ ID NO: 3149 - protein, 123 aa, Mus musculus
FCAMKADDGPCKAMIRSYFFNMYTHQCEEFIYGGCEGNENRFDTLEECKKTCIPGYEKTAVKAASGAERPDFCFLEEDPGLCRGYMKRYLYNNQTKQCERFVYGGCLGNRNNFETLDECKKIC

SEQ ID NO: 3150 - protein, 123 aa, Rattus norvegicus
FCAMKAEDGPCKAMIRSYYFNMNSHQCEEFIYGGCRGNKNRFDTLEECRKTCIPGYKKTTIKTTSGAEKPDFCFLEEDPGICRGFMTRYFYNNQSKQCEQFKYGGCLGNSNNFETLEECRNTC

SEQ ID NO: 3151 - protein, 20 aa, Artificial Sequence
  Synthetic peptide
  MOD_RES (1)..(1): Xaa is selected from the group consisting of Phe, Leu, Met, Tyr, 1Ni, Thi, Bta, and Dopa
  MOD_RES (3)..(3): Xaa is selected from the group consisting of Cys, Asp, Glu, Met, Gln, Arg, Ser, Thr, Ede(O), and Cmc
  MOD_RES (4)..(4): Xaa is selected from the group consisting of Aib, Glu, Gly, Ile, Lys, Lue, Met, Pro, Arg, Trp, and Tyr
  MOD_RES (5)..(5): Xaa is selected from the group consisting of D-Ala, Ala, Aib, Cys, Asp, D-Asp, Glu, Gly, His, Lys, D-Lys, Met, Asn, Nmg, D-Pro, Gln, Arg, NpropylG, aze, pip, tic, oic, hyp, nma, Ncg, Abg, Apg, thz, and dtc
  MOD_RES (6)..(6): Xaa is selected from the group consisting of Ala, Cys, C(NEM), Asp, Glu, Gly, His, Lys, Met, Asn, Gln, Arg, Ser, Val, Cit, C(Acm), Nle, Ile, Ede(O), Cmc, Ecl, Eea, Eec, Eef, Nif, and Eew
  MOD_RES (7)..(7): Xaa is selected from the group consisting of Ile, Val, Thr, Chg, Phg, and Tle
  MOD_RES (8)..(8): Xaa is selected from the group consisting of Phe, His, 1Ni, 2Ni, Pmy, and Tyr
  MOD_RES (9)..(9): Xaa is selected from the group consisting of Aib, Val, Chg, Phg, Abu, Cpg, Tle, and L-2-amino-4,4,4-trifluorobutyric acid
  MOD_RES (10)..(10): Xaa is selected from the group consisting of Ala, Cys, Asp, D-Asp, Glu, Phe, His, Lys, Met, Asn, Pro, Gln, Arg, Ser, Thr, Val, Trp, Tyr, Nmd, and C(NEM)
  MOD_RES (11)..(11): Xaa is selected from the group consisting of Ala, D-Ala, Gly, D-Pro, Sar, D-Cys, and hcy
  MOD_RES (12)..(12): Xaa is selected from the group consisting of Tyr, Tym, Pty, Dopa, and Pmy
  MOD_RES (13)..(13): Xaa is selected from the group consisting of Cys, Phe, 1Ni, Thi, and Bta
  MOD_RES (14)..(14): Xaa is selected from the group consisting of Ala, Aib, Cys, C(NEM), Asp, Glu, Lys, Leu, Met, Asn, Gln, Arg, Thr, Val, and Hcy
  MOD_RES (16)..(16): Xaa is selected from the group consisting of Leu, Hcy, Hle, and Aml
  MOD_RES (17)..(17): Xaa is selected from the group consisting of Ala, D-Ala, Aib, Cys, D-Cys, Cha, Dab, Eag, Eew, His, Har, Hci, Hle, Ile, Lys, Leu, Met, Nle, Nva, Opa, Orn, Arg, Ser, Deg, Ebc, Eca, Egz, Aic, Apc, and Egt
  MOD_RES (18)..(18): Xaa is selected from the group consisting of Ala, Aib, Hcy, hcy, Cys, D-Cys, Leu, Nle, Met, Asn, and Arg
  MOD_RES (19)..(19): Xaa is selected from the group consisting of Lys, Arg, and Har
  MOD_RES (20)..(20): Xaa is selected from the group consisting of Lys, Leu, Hcy, and Aml
XQXXXXXXXXXXXXRXXXXX

SEQ ID NO: 3152 - protein, 24 aa, Artificial Sequence
  Synthetic peptide
  MOD_RES (1)..(1): Xaa is selected from the group consisting of Phe, Leu, Met, and Tyr
  MOD_RES (3)..(3): Xaa is selected from the group consisting of Cys, Asp, Glu, Met, Gln, Arg, Ser, and Thr
  MOD_RES (4)..(4): Xaa is selected from the group consisting of Glu, Gly, Ile, Lys, Leu, Met, Pro, Arg, Trp, and Tyr
  MOD_RES (5)..(5): Xaa is selected from the group consisting of D-Ala, Ala, Aib, Cys, Asp, D-Asp, Glu, Gly, His, Lys, D-Lys, Met, Asn, Nmg, Gln, Arg, and D-Pro
  MOD_RES (6)..(6): Xaa is selected from the group consisting of Ala, Cys, Asp, Glu, Gly, His, Lys, Met, Asn, Gln, Arg, Ser, and Val
  MOD_RES (8)..(8): Xaa is selected from the group consisting of Phe, His, and Tyr
  misc_feature (9)..(9): Xaa can be any naturally occurring amino acid
  MOD_RES (10)..(10): Xaa is selected from the group consisting of Ala, Cys, Asp, Glu, Phe, His, Met, Asn, Pro, Gln, Arg, Ser, Thr, Val, Trp, and Tyr
  MOD_RES (13)..(13): Xaa is selected from the group consisting of Aib, Cys, and Phe
  MOD_RES (14)..(14): Xaa is selected from the group consisting of Ala, Aib, Cys, Asp, Glu, Lys, Leu, Met, Asn, Gln, Arg, Thr, and Val
  MOD_RES (17)..(17): Xaa is selected from the group consisting of Ala, Aib, Cys, Cha, Dab, Eag, Eew, His, Har, Hci, Hle, Ile, Lys, Leu, Met, Nle, Nve, Opa, Orn, Arg, and Ser
  MOD_RES (18)..(18): Xaa is selected from the group consisting of Ala, Cys, Leu, Met, Asn, and Arg
  MOD_RES (19)..(19): Xaa is Lys or Leu
  misc_feature (21)..(22): Xaa can be any naturally occurring amino acid
  misc_feature (24)..(24): Xaa can be any naturally occurring amino acid
XQXXXXIVXAIBVXGYXXRLXXKX

SEQ ID NO: 3153 - protein, 20 aa, Artificial Sequence
  Synthetic peptide
  MOD_RES (1)..(1): Xaa is selected from the group consisting of Phe, Leu, Met, Tyr, 1Ni, Thi, Bta, Dopa, Bhf, Cys, Asp, Gly, His, Ile, Lys, Asn, Nmf, Gln, Arg, Thr, Val, and Trp
  MOD_RES (2)..(2): Xaa is selected from the group consisting of Gln, Gly, and Lys
  MOD_RES (3)..(3): Xaa is selected from the group consisting of Cys, Asp, Glu, Met, Gln, Arg, Ser, Thr, Ede(O), Cmc, Ala, Aib, Bhs, Phe, Gly, His, Ile, Lys, Leu, Asn, Pro, Val, Trp and Tyr
  MOD_RES (4)..(4): Xaa is selected from the group consisting of Aib, Glu, Gly, Ile, Lys, Leu, Met, Pro, Arg, Trp, Tyr, Ala, Bhk, Cys, Asp, Phe, His, D-Lys, Asn, Nmk, Gln, Ser, Thr and Val
  MOD_RES (5)..(5): Xaa is selected from the group consisting of D-Ala, Ala, Aib, Cys, Asp, D-Asp, Glu, Gly, His, Lys, D-Lys, Met, Asn, Nmg, D-Pro, Gln, Arg, NpropylG, aze, pip, tic, oic, hyp, nma, Ncg, Abg, Apg, thz, dtc, Bal, Phe, Leu, Ser, Thr, Val, Trp and Tyr
  MOD_RES (6)..(6): Xaa is selected from the group consisting of Ala, Cys, C(NEM), Asp, Glu, Gly, His, Lys, Met, Asn, Gln, Arg, Ser, Val, Cit, C(Acm), Nle, Ile, Ede(O), Cmc, Ecl, Eea, Eec, Eef, Nif, Eew, Aib, Btq, Phe, Leu, Thr, Trp and Tyr
  MOD_RES (7)..(7): Xaa is selected from the group consisting of Ile, Val, Thr, Chg, Phg, Tle, Ala, Phe, Gly, Ile, Lys, Leu, Nmv, Pro, Gln, Ser, Trp and Tyr
  MOD_RES (8)..(8): Xaa is selected from the group consisting of Phe, His, 1Ni, 2Ni, Pmy, Tyr, and Trp
  MOD_RES (9)..(9): Xaa is selected from the group consisting of Aib, Val, Chg, Phg, Abu, Cpg, Tle, L-2-amino-4,4,4-trifluorobutyric acid, Ala, D-Phe, Ile, Lys, Ser, Thr and Val
  MOD_RES (10)..(10): Xaa is selected from the group consisting of Ala, Cys, Asp, D-Asp, Glu, Phe, His, Lys, Met, Asn, Pro, Gln, Arg, Ser, Thr, Val, Trp, Tyr, Nmd, C(NEM), Aib, Gly, Ile, Leu and Nmf
  MOD_RES (11)..(11): Xaa is selected from the group consisting of Ala, D-Ala, Gly, D-Pro, Sar, D-Cys, hcy, Aib, Cys, Lys, Gly and Nmg
  MOD_RES (12)..(12): Xaa is selected from the group consisting of Tyr, Tym, Pty, Dopa and Pmy
  MOD_RES (13)..(13): Xaa is selected from the group consisting of Aib, Cys, Phe, 1Ni, Thi, Bta, Ala, Glu, Gly, His, Lys, Leu, Met, Gln, Arg, Trp and Tyr
  MOD_RES (14)..(14): Xaa is selected from the group consisting of Ala, Aib, Cys, C(NEM), Asp, Glu, Lys, Leu, Met, Asn, Gln, Arg, Thr, Val, Hcy, Bhe, Phe, Gly, His, Ile, Pro, Ser, Trp and Tyr
  MOD_RES (15)..(15): Xaa is selected from the group consisting of Arg, (omega-methyl)-Arg, Asp, Glu and Lys
  MOD_RES (16)..(16): Xaa is selected from the group consisting of Leu, Hcy, Hle and Aml
  MOD_RES (17)..(17): Xaa is selected from the group consisting of Ala, D-Ala, Aib, Cys, D-Cys, Cha, Dab, Eag, Eew, His, Har, Hci, Hle, Ile, Lys, Leu, Met, Nle, Nva, Opa, Orn, Arg, Ser, Deg, Ebc, Eca, Egz, Aic, Apc, Egt, (omega-methyl)-Arg, Bhr, Cit, Asp, Dap, Glu, Asn, Gln,
  MOD_RES (17)..(17): Val, Trp and Tyr
  MOD_RES (18)..(18): Xaa is selected from the group consisting of Ala, Aib, Hcy, hcy, Cys, D-Cys, Leu, Nle, Met, Asn, Arg, Bal, Asp, Glu, Phe, Gly, His, Ile, Lys, Gln, Ser, Thr, Val, Trp and Tyr
  MOD_RES (19)..(19): Xaa is selected from the group consisting of Lys, Arg, Har, Bhk and Val
  MOD_RES (20)..(20): Xaa is selected from the group consisting of Lys, Leu, Hcy, Aml, Aib, Bhl, Cys, Phe, Gly, His, Ile, Nml, Gln, Arg, Ser, Tjr, Val, Trp and Tyr
XXXXXXXXXXXXXXXXXXXX

SEQ ID NO: 3154 - protein, 23 aa, Artificial Sequence
  Synthetic peptide
  MOD_RES (1)..(1): Xaa is selected from the group consisting of Ala, Cys, C(NEM), Asp, Glu, Phe, Gly, His, Ile, Lys, Leu, Pro, Arg, Ser, Thr, Val and Trp or is absent
  MOD_RES (2)..(2): Xaa is selected from the group consisting of Ala, Cys, C(NEM), Asp, Glu, Phe, Gly, His, Ile, Lys, Leu, Met, Pro, Gln, Arg, Ser, Thr, Val, Trp and Tyr or is absent
  MOD_RES (3)..(3): Xaa is selected from the group consisting of Ala, Phe, Ile, Lys, Leu, Arg, Ser, Thr, Val, Trp and Tyr
  MOD_RES (4)..(4): Xaa is selected from the group consisting of Ala, Asp, Glu, Phe, Gly, Ile, Lys, Leu, Arg, Ser, Thr, Val and Trp
  MOD_RES (5)..(5): Xaa is Arg or Trp
  MOD_RES (6)..(6): Xaa is selected from the group consisting of Phe, His, Ile, Lys, Leu, Arg, Val and Trp
  DISULFID (7)..(18): Residues linked via disulfide bond
  MOD_RES (7)..(7): Xaa is selected from the group consisting of Orn, homoK, Cys, Hcy, Dap and Lys, preferably selected from the group consisting of Cys and Hcy
  MOD_RES (8)..(8): Xaa is selected from the group consisting of Arg, Gly, Arg, Ser and Thr
  MOD_RES (9)..(9): Xaa is selected from the group consisting of D-Ala, Ala, Ile, Lys, Leu, Met, D-Met, Moo, Nle, D-Pro, Arg, Sem and Val
  MOD_RES (10)..(10): Xaa is selected from the group consisting of Ala, Gly, Ile, Lys, Leu, Pro, Arg, Ser, Thr and Val
  MOD_RES (11)..(11): Xaa is selected from the group consisting of Asp, Glu, Gly, Ser and Thr
  MOD_RES (12)..(12): Xaa is selected from the group consisting of Ala, D-Ala, Asp, D-Asp, Glu, D-Glu, Phe, D-Phe, Gly, Ile, Lys, D-Lys, Leu, lle, Met, D-Met, Moo, Nle, nle, Pro, D-Pro, Arg, D-Arg, Ser, D-Ser, Sem, Thr, D-Thr, Val, D-Val , Trp and D-Trp
  MOD_RES (13)..(13): Xaa is selected from the group consisting of Ala, Cys, C(NEM), Con, Con(Meox), Asp, D-Asp, Glu, D-Glu, Eag, Phe, Gly, Ile, Lys, Leu, Asn, Arg, Ser, D-Ser, Thr, Val and Trp
  MOD_RES (14)..(14): Xaa is selected from the group consisting of Ala, Asp, Glu, Phe, Gly, Ile, Lys, Leu, Met, Arg, Ser, Thr, Val and Trp
  MOD_RES (15)..(15): Xaa is selected from the group consisting of Ala, Asp, Glu, Phe, Gly, Ile, Lys, Leu, Met, Nle, Arg, Ser, Thr, Val and Trp
  MOD_RES (16)..(16): Xaa is selected from the group consisting of Ala, Asp, Glu, Phe, Ile, Lys, Leu, Met, Moo, Nle, Arg, Ser, Sem, Thr, Val, Trp and Tyr
  MOD_RES (17)..(17): Xaa is selected from the group consisting of Ala, Asp, Glu, Phe, Gly, Ile, Lys, Leu, Arg, Ser, Thr, Val, Trp and Tyr
  MOD_RES (18)..(18): Xaa is selected from the group consisting of Cys and Asp
  MOD_RES (19)..(19): Xaa is selected from the group consisting of Ala, Phe, Ile, Leu, Ser, Thr, Val and Trp
  MOD_RES (20)..(20): Xaa is selected from the group consisting of Phe and Trp
  MOD_RES (21)..(21): Xaa is selected from the group consisting of Ile, Leu and Val
  MOD_RES (22)..(22): Xaa is selected from the group consisting of Ala, Asp, Glu, Phe, Gly, Ile, Lys, Leu, Pro, Arg, Ser, Thr, Val and Trp
  MOD_RES (23)..(23): Xaa is selected from the group consisting of Ala, Cys, Cys(NEM), Con, Con(Meox), Asp, Glu, Eag, Phe, Gly, Ile, Lys, Leu, Arg, Ser, Thr, Val, Trp and Tyr or is absent
XXXXXXXXXXXXXXXXXXXXXXX

SEQ ID NO: 3155-4000 - skipped (846 entries)

SEQ ID NO: 4001 - protein, 35 aa, Artificial Sequence; identical to SEQ ID NO: 8
  Synthetic peptide
  MOD_RES (1)..(1): N-terminal acetylation
  MOD_RES (1)..(1): Carboxyfluoresceine
  MOD_RES (35)..(35): C-terminal amidation

SEQ ID NO: 4002 - protein, 35 aa, Artificial Sequence; identical to SEQ ID NO: 8
  Synthetic peptide
  MOD_RES (1)..(1): N-terminal acetylation
  MOD_RES (35)..(35): Carboxyfluoresceine
  MOD_RES (35)..(35): C-terminal amidation

SEQ ID NO: 4003 - protein, 20 aa, Artificial Sequence
  Synthetic peptide
  MOD_RES (1)..(1): N-terminal acetylation
  MOD_RES (20)..(20): C-terminal amidation
FQSKKNVFVFGYFERLRAKL

SEQ ID NO: 4004 - protein, 20 aa, Artificial Sequence
  Synthetic peptide
  MOD_RES (1)..(1): N-terminal acetylation
  MOD_RES (20)..(20): C-terminal amidation
FQSKKNVFVDGYFERLRAKL

SEQ ID NO: 4005 - protein, 21 aa, Artificial Sequence
  Synthetic peptide
  MOD_RES (1)..(1): Carboxyfluoresceine
  MOD_RES (1)..(1): Xaa is N-(3-{2-[2-(3-Amino-propoxy)-ethoxy]-ethoxy}-propyl)-succinamic acid
  MOD_RES (21)..(21): C-terminal amidation
XAFQSKKNVFVFGYFERLRAK

SEQ ID NO: 4006 - protein, 20 aa, Artificial Sequence
  Synthetic peptide
  MOD_RES (1)..(1): Carboxyfluoresceine
  MOD_RES (20)..(20): C-terminal amidation
AFQSKKNVFVFGYFERLRAK

SEQ ID NO: 4007 - protein, 20 aa, Artificial Sequence
  Synthetic peptide
  MOD_RES (1)..(1): N-terminal acetylation
  MOD_RES (20)..(20): C-terminal amidation
FQSKGNVFVFGYFERLRAKL

SEQ ID NO: 4008-4009 - skipped (2 entries)

SEQ ID NO: 4010 - protein, 20 aa, Artificial Sequence
  Synthetic peptide
  MOD_RES (1)..(1): N-terminal acetylation
  MOD_RES (20)..(20): C-terminal amidation
FQSKGNVFVDGYFERLRAKL

SEQ ID NO: 4011 - protein, 20 aa, Artificial Sequence
  Synthetic peptide
  MOD_RES (1)..(1): N-terminal acetylation
  MOD_RES (1)..(1): N-methyl-Phe
  MOD_RES (20)..(20): C-terminal amidation
FQSKGNVFVFGYFERLRAKL

SEQ ID NO: 4012 - protein, 20 aa, Artificial Sequence
  Synthetic peptide
  MOD_RES (1)..(1): N-terminal acetylation
  MOD_RES (17)..(17): Xaa is 2-amino-isobutyric acid
  MOD_RES (20)..(20): C-terminal amidation
FQSKGNVFVDGYFERLXAKL

SEQ ID NO: 4013 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (21)..(21): C-terminal amidation
XFQSKGNVFVDGYFERLRAKL

SEQ ID NO: 4014 - protein, 20 aa, Artificial Sequence
  Synthetic peptide
  MOD_RES (1)..(1): N-terminal acetylation
  MOD_RES (5)..(5): D-Ala
  MOD_RES (17)..(17): Xaa is norleucine
  MOD_RES (20)..(20): C-terminal amidation
FQSKANVFVDGYFARLXAKL

SEQ ID NO: 4015 - protein, 20 aa, Artificial Sequence
  Synthetic peptide
  MOD_RES (1)..(1): N-terminal acetylation
  MOD_RES (20)..(20): C-terminal amidation
YQSKNNVFVDGYFERLCAKL

SEQ ID NO: 4016 - protein, 20 aa, Artificial Sequence
  Synthetic peptide
  MOD_RES (1)..(1): N-terminal acetylation
  MOD_RES (20)..(20): N-terminal amidation
FQSKERVFVDGYFERLCAKL

SEQ ID NO: 4017 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-amino-isobutyric acid
  MOD_RES (20)..(20): C-terminal amidation
FQSKGNVFVDGYFERLXAKL

SEQ ID NO: 4018 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-amino-isobutyric acid
  MOD_RES (20)..(20): C-terminal amidation
FQSKGNVFVDGYFERLXAKL

SEQ ID NO: 4019 - protein, 21 aa, Artificial Sequence
  Synthetic peptide
  MOD_RES (1)..(1): N-terminal acetylation
  MOD_RES (17)..(17): Xaa is 2-amino-isobutyric acid
  MOD_RES (21)..(21): Cys-PEG
  MOD_RES (21)..(21): C-terminal amidation
FQSKGNVFVDGYFERLXAKLC

SEQ ID NO: 4020 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPNVHVDGYFERLXAKL

SEQ ID NO: 4021 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (21)..(21): C-terminal amidation
XQKVRFVLDKEAGSFLYRGFN

SEQ ID NO: 4022 - protein, 9 aa, Artificial Sequence
  Synthetic peptide
  MOD_RES (1)..(1): N-terminal acetylation
  MOD_RES (9)..(9): C-terminal amidation
FQSKKNVFV

SEQ ID NO: 4023 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (6)..(6): N-methyl-Gly
  MOD_RES (18)..(18): Xaa is 2-amino-isobutyric acid
  MOD_RES (21)..(21): C-terminal amidation
XFQSKGNVFVDGYFERLXAKL

SEQ ID NO: 4024 - protein, 21 aa, Artificial Sequence
  Synthetic peptide
  MOD_RES (1)..(1): Carboxyfluorsceine
  MOD_RES (1)..(1): Xaa is N-(3-{2-[2-(3-Amino-propoxy)-ethoxy]-ethoxy}-propyl)-succinamic acid
  MOD_RES (6)..(6): N-methyl Gly
  MOD_RES (18)..(18): Xaa is 2-amino-isobutyric acid
  MOD_RES (21)..(21): C-terminal amidation
XFQSKGNVFVDGYFERLXAKL

SEQ ID NO: 4025 - protein, 20 aa, Artificial Sequence
  Synthetic peptide
  MOD_RES (1)..(1): N-terminal acetylation
  MOD_RES (3)..(3): N-methyl-Gly
  MOD_RES (14)..(14): Xaa is 2-amino-isobutyric acid
  MOD_RES (20)..(20): C-terminal amidation
FKGVSAEYDVGLLXKFFQRN

SEQ ID NO: 4026 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (4)..(4): N-methyl-Gly
  MOD_RES (15)..(15): Xaa is 2-amino-isobutyric acid
  MOD_RES (21)..(21): C-terminal amidation
XFKGVSAEYDVGLLXKFFQRN

SEQ ID NO: 4027 - protein, 21 aa, Artificial Sequence
  Synthetic peptide
  MOD_RES (1)..(1): Carboxyfluoresceine
  MOD_RES (1)..(1): Xaa is N-(3-{2-[2-(3-Amino-propoxy)-ethoxy]-ethoxy}-propyl)-succinamic acid
  MOD_RES (4)..(4): N-methyl-Gly
  MOD_RES (15)..(15): Xaa is 2-amino-isobutyric acid
  MOD_RES (21)..(21): C-terminal amidation
XFKGVSAEYDVGLLXKFFQRN

SEQ ID NO: 4028 - protein, 21 aa, Artificial Sequence
  Synthetic peptide
  MOD_RES (1)..(1): N-terminal acetylation
  MOD_RES (21)..(21): C-terminal amidation
PFQSKGNVFVDGYFERLRAKL

SEQ ID NO: 4029 - protein, 22 aa, Artificial Sequence
  Synthetic peptide
  MOD_RES (1)..(1): N-terminal acetylation
  MOD_RES (22)..(22): C-terminal amidation
PEFQSKGNVFVDGYFERLRAKL

SEQ ID NO: 4030 - protein, 21 aa, Artificial Sequence
  Synthetic peptide
  MOD_RES (1)..(1): N-terminal acetylation
  MOD_RES (6)..(6): N-methyl-Gly
  MOD_RES (18)..(18): Xaa is 2-amino-isobutyric acid
  MOD_RES (21)..(21): C-terminal amidation
PFQSKGNVFVDGYFERLXAKL

SEQ ID NO: 4031 - protein, 20 aa, Artificial Sequence
  Synthetic peptide
  MOD_RES (1)..(1): N-terminal acetylation
  MOD_RES (5)..(5): N-methyl-Gly
  MOD_RES (17)..(17): Xaa is 2-amino-isobutyric acid
  MOD_RES (20)..(20): C-terminal amidation
YQTKGNVFVDGYFERLXAKL

SEQ ID NO: 4032 - protein, 22 aa, Artificial Sequence
  Synthetic peptide
  MOD_RES (1)..(1): N-terminal acetylation
  MOD_RES (7)..(7): N-methyl-Gly
  MOD_RES (19)..(19): Xaa is 2-amino-isobutyric acid
  MOD_RES (22)..(22): C-terminal amidation
PEFQSKGNVFVDGYFERLXAKL

SEQ ID NO: 4033 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (6)..(6): D-Pro
  MOD_RES (18)..(18): Xaa is 2-amino-isobutyric acid
  MOD_RES (21)..(21): C-terminal amidation
XFQSKPNVHVDGYFERLXAKL

SEQ ID NO: 4034 - protein, 20 aa, Artificial Sequence
  Synthetic peptide
  MOD_RES (1)..(1): N-terminal acetylation
  MOD_RES (8)..(8): N-methyl-Gly
  MOD_RES (19)..(19): Xaa is 2-amino-isobutyric acid
  MOD_RES (20)..(20): C-terminal amidation
GKRLKFDGYLFNEAVQSFXV

SEQ ID NO: 4035 - protein, 20 aa, Artificial Sequence
  Synthetic peptide
  MOD_RES (1)..(1): N-terminal acetylation
  MOD_RES (1)..(1): N-methyl-Gly
  MOD_RES (9)..(9): Xaa is 2-amino-isobutyric acid
  MOD_RES (20)..(20): C-terminal amidation
GLYFKANFXSVDQFEVGRLK

SEQ ID NO: 4036 - protein, 20 aa, Artificial Sequence
  Synthetic peptide
  MOD_RES (1)..(1): N-terminal acetylation
  MOD_RES (5)..(5): N-Propyl-Gly
  MOD_RES (17)..(17): Xaa is 2-amino-isobutyric acid
  MOD_RES (20)..(20): C-terminal amidation
FQSKGNVHVDGYFERLXAKL

SEQ ID NO: 4037 - protein, 20 aa, Artificial Sequence
  Synthetic peptide
  MOD_RES (1)..(1): N-terminal acetylation
  MOD_RES (5)..(5): Xaa is D-Azetidine-2-carboxylic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4038 - protein, 20 aa, Artificial Sequence
  Synthetic peptide
  MOD_RES (1)..(1): N-terminal acetylation
  MOD_RES (5)..(5): Xaa is D-Pipecolic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4039 - protein, 20 aa, Artificial Sequence
  Synthetic peptide
  MOD_RES (1)..(1): N-terminal acetylation
  MOD_RES (5)..(5): Xaa is D-1,2,3,4-Tetrahydro-isoquinoline-3-carboxylic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4040 - protein, 20 aa, Artificial Sequence
  Synthetic peptide
  MOD_RES (1)..(1): N-terminal acetylation
  MOD_RES (5)..(5): Xaa is D-Octahydro-indole-2-carboxylic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4041 - protein, 20 aa, Artificial Sequence
  Synthetic peptide
  MOD_RES (1)..(1): N-terminal acetylation
  MOD_RES (5)..(5): Xaa is D-Hydroxyproline
  MOD_RES (17)..(17): Xaa is 2-amino-isobutyric acid
  MOD_RES (20)..(20): C-terminal amidation
FQSKXNVHVDGYFERLXAKL

SEQ ID NO: 4042 - protein, 20 aa, Artificial Sequence
  Synthetic peptide
  MOD_RES (1)..(1): N-terminal acetylation
  MOD_RES (5)..(5): N-Methyl-Ala
  MOD_RES (17)..(17): Xaa is 2-amino-isobutyric acid
  MOD_RES (20)..(20): C-terminal amidation
FQSKANVHVDGYFERLXAKL

SEQ ID NO: 4043 - protein, 20 aa, Artificial Sequence
  Synthetic peptide
  MOD_RES (1)..(1): N-terminal aceytlation
  MOD_RES (5)..(5): Xaa is N-Cyclohexyl Gly
  MOD_RES (17)..(17): Xaa is 2-amino-isobutyric acid
  MOD_RES (20)..(20): C-terminal amidation
FQSKGNVHVDGYFERLXAKL

SEQ ID NO: 4044 - protein, 20 aa, Artificial Sequence
  Synthetic peptide
  MOD_RES (1)..(1): N-terminal acetylation
  MOD_RES (5)..(5): Xaa is (4-Amino-butylamino)-acetic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4045 - protein, 20 aa, Artificial Sequence
  Synthetic peptide
  MOD_RES (1)..(1): N-terminal acetylation
  MOD_RES (5)..(5): Xaa is (3-Amino-propylamino)-acetic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4046 - protein, 20 aa, Artificial Sequence
  Synthetic peptide
  MOD_RES (1)..(1): N-terminal acetylation
  MOD_RES (5)..(5): Xaa is D-2,2-Thiazolidine-4-carboxylic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4047 - protein, 20 aa, Artificial Sequence
  Synthetic peptide
  MOD_RES (1)..(1): N-terminal acetylation
  MOD_RES (5)..(5): Xaa is D-2,2-Dimethyl-thiazolidine-4-carboxylic acid
  MOD_RES (17)..(17): Xaa is 2-amino-isobutyric acid
  MOD_RES (20)..(20): C-terminal amidation
FQSKXNVHVDGYFERLXAKL

SEQ ID NO: 4048 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPPVHVDGYFERLXAKL

SEQ ID NO: 4049 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-methyl-Asn
  MOD_RES (17)..(17): Xaa is 2-amino-isobutyric acid
  MOD_RES (20)..(20): C-terminal amidation
FQSKPNVHVDGYFERLXAKL

SEQ ID NO: 4050 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-methyl-Ala
  MOD_RES (17)..(17): Xaa is 2-amino-isobutyric acid
  MOD_RES (20)..(20): C-terminal amidation
FQSKPAVHVDGYFERLXAKL

SEQ ID NO: 4051 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-methyl-Lys
  MOD_RES (17)..(17): Xaa is 2-amino-isobutyric acid
  MOD_RES (20)..(20): C-terminal amidation
FQSKPKVHVDGYFERLXAKL

SEQ ID NO: 4052 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-methyl-Arg
  MOD_RES (17)..(17): Xaa is 2-amino-isobutyric acid
  MOD_RES (20)..(20): C-terminal amidation
FQSKPRVHVDGYFERLXAKL

SEQ ID NO: 4053 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-methyl-Ser
  MOD_RES (17)..(17): Xaa is 2-amino-isobutyric acid
  MOD_RES (20)..(20): C-terminal amidation
FQSKPSVHVDGYFERLXAKL

SEQ ID NO: 4054 - protein, 20 aa, Artificial Sequence
  Synthetic peptide
  MOD_RES (1)..(1): N-terminal acetylation
  MOD_RES (5)..(5): D-Pro
  MOD_RES (6)..(6): D-Asn
  MOD_RES (17)..(17): Xaa is 2-amino-isobutyric acid
  MOD_RES (20)..(20): C-terminal amidation
FQSKPNVHVDGYFERLXAKL

SEQ ID NO: 4055 - protein, 20 aa, Artificial Sequence
  Synthetic peptide
  MOD_RES (1)..(1): N-terminal acetylation
  MOD_RES (5)..(5): D-Pro
  MOD_RES (7)..(7): Cyclohexyl Gly
  MOD_RES (17)..(17): Xaa is 2-amino-isobutyric acid
  MOD_RES (20)..(20): C-terminal amidation
FQSKPNGHVDGYFERLXAKL

SEQ ID NO: 4056 - protein, 20 aa, Artificial Sequence
  Synthetic peptide
  MOD_RES (1)..(1): N-terminal acetylation
  MOD_RES (5)..(5): D-Pro
  MOD_RES (9)..(9): Cyclohexyl Gly
  MOD_RES (17)..(17): Xaa is 2-amino-isobutyric acid
  MOD_RES (20)..(20): C-terminal amidation
FQSKPNVHGDGYFERLXAKL

SEQ ID NO: 4057 - protein, 20 aa, Artificial Sequence
  Synthetic peptide
  MOD_RES (1)..(1): N-terminal acetylation
  MOD_RES (5)..(5): D-Pro
  MOD_RES (7)..(7): Cyclohexyl Gly
  MOD_RES (9)..(9): Cyclohexyl Gly
  MOD_RES (17)..(17): Xaa is 2-amino-isobutyric acid
  MOD_RES (20)..(20): C-terminal amidation
FQSKPNGHGDGYFERLXAKL

SEQ ID NO: 4058 - protein, 20 aa, Artificial Sequence
  Synthetic peptide
  MOD_RES (1)..(1): N-terminal acetylation
  MOD_RES (5)..(5): D-Pro
  MOD_RES (7)..(7): Phenyl Gly
  MOD_RES (17)..(17): Xaa is 2-amino-isobutyric acid
  MOD_RES (20)..(20): C-terminal amidation
FQSKPNGHVDGYFERLXAKL

SEQ ID NO: 4059 - protein, 20 aa, Artificial Sequence
  Synthetic peptide
  MOD_RES (1)..(1): N-terminal acetylation
  MOD_RES (5)..(5): D-Pro
  MOD_RES (9)..(9): Phenyl Gly
  MOD_RES (17)..(17): Xaa is 2-amino-isobutyric acid
  MOD_RES (20)..(20): C-terminal amidation
FQSKPNVHGDGYFERLXAKL

SEQ ID NO: 4060 - protein, 20 aa, Artificial Sequence
  Synthetic peptide
  MOD_RES (1)..(1): N-terminal acetylation
  MOD_RES (5)..(5): D-Pro
  MOD_RES (7)..(7): Phenyl Gly
  MOD_RES (9)..(9): Phenyl Gly
  MOD_RES (17)..(17): Xaa is 2-amino-isobutyric acid
  MOD_RES (20)..(20): C-terminal amidation
FQSKPNGHGDGYFERLXAKL

SEQ ID NO: 4061 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 3-aminopentane-3-carboxylic acid
  MOD_RES (20)..(20): C-terminal amidation
FQSKPNVHVDGYFERLXAKL

SEQ ID NO: 4062 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 1-Amino-cyclopropane carboxylic acid
  MOD_RES (20)..(20): C-terminal amidation
FQSKPNVHVDGYFERLXAKL

SEQ ID NO: 4063 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 1-amino-cyclopentane carboxylic acid
  MOD_RES (20)..(20): C-terminal amidation
FQSKPNVHVDGYFERLXAKL

SEQ ID NO: 4064 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 1-Amino-cyclohexane carboxylic acid
  MOD_RES (20)..(20): C-terminal amidation
FQSKPNVHVDGYFERLXAKL

SEQ ID NO: 4065 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-aminoindane-2-carboxylic acid
  MOD_RES (20)..(20): C-terminal amidation
FQSKPNVHVDGYFERLXAKL

SEQ ID NO: 4066 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 4-Amino-piperidine-4-carboxylic acid
  MOD_RES (20)..(20): C-terminal amidation
FQSKPNVHVDGYFERLXAKL

SEQ ID NO: 4067 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-Amino-2-butyl-hexanoic acid
  MOD_RES (20)..(20): C-terminal amidation
FQSKPNVHVDGYFERLXAKL

SEQ ID NO: 4068 - protein, 20 aa, Artificial Sequence
  Synthetic peptide
  MOD_RES (1)..(1): N-terminal acetylation
  MOD_RES (1)..(1): 1-naphtyl-Ala
  MOD_RES (5)..(5): D-Pro
  MOD_RES (17)..(17): Xaa is 2-amino-isobutyric acid
  MOD_RES (20)..(20): C-terminal amidation
AQSKPNVHVDGYFERLXAKL

SEQ ID NO: 4069 - protein, 20 aa, Artificial Sequence
  Synthetic peptide
  MOD_RES (1)..(1): N-terminal acetylation
  MOD_RES (1)..(1): 2-Thienyl-Ala
  MOD_RES (5)..(5): D-Pro
  MOD_RES (17)..(17): Xaa is 2-amino-isobutyric acid
  MOD_RES (20)..(20): C-terminal amidation
AQSKPNVHVDGYFERLXAKL

SEQ ID NO: 4070 - protein, 20 aa, Artificial Sequence
  Synthetic peptide
  MOD_RES (1)..(1): N-terminal acetylation
  MOD_RES (1)..(1): Benzothienyl-Ala
  MOD_RES (5)..(5): D-Pro
  MOD_RES (17)..(17): Xaa is 2-amino-isobutyric acid
  MOD_RES (20)..(20): C-terminal amidation
AQSKPNVHVDGYFERLXAKL

SEQ ID NO: 4071 - protein, 20 aa, Artificial Sequence
  Synthetic peptide
  MOD_RES (1)..(1): N-terminal acetylation
  MOD_RES (5)..(5): D-Pro
  MOD_RES (13)..(13): 1-naphtyl-Ala
  MOD_RES (17)..(17): Xaa is 2-amino-isobutyric acid
  MOD_RES (20)..(20): C-terminal amidation
FQSKPNVHVDGYAERLXAKL

SEQ ID NO: 4072 - protein, 20 aa, Artificial Sequence
  Synthetic peptide
  MOD_RES (1)..(1): N-terminal acetylation
  MOD_RES (5)..(5): D-Pro
  MOD_RES (13)..(13): 2-Thienyl-Ala
  MOD_RES (17)..(17): Xaa is 2-amino-isobutyric acid
  MOD_RES (20)..(20): C-terminal amidation
FQSKPNVHVDGYAERLXAKL

SEQ ID NO: 4073 - protein, 20 aa, Artificial Sequence
  Synthetic peptide
  MOD_RES (1)..(1): N-terminal acetylation
  MOD_RES (5)..(5): D-Pro
  MOD_RES (13)..(13): Benzothienyl-Ala
  MOD_RES (17)..(17): Xaa is 2-amino-isobutyric acid
  MOD_RES (20)..(20): C-terminal amidation
FQSKPNVHVDGYAERLXAKL

SEQ ID NO: 4074 - protein, 20 aa, Artificial Sequence
  Synthetic peptide
  MOD_RES (1)..(1): N-terminal acetylation
  MOD_RES (5)..(5): D-Pro
  MOD_RES (12)..(12): 3-Nitro-Tyr
  MOD_RES (17)..(17): Xaa is 2-amino-isobutyric acid
  MOD_RES (20)..(20): C-terminal amidation
FQSKPNVHVDGYFERLXAKL

SEQ ID NO: 4075 - protein, 20 aa, Artificial Sequence
  Synthetic peptide
  MOD_RES (1)..(1): N-terminal acetylation
  MOD_RES (5)..(5): D-Pro
  MOD_RES (12)..(12): Phospho-Tyr
  MOD_RES (17)..(17): Xaa is 2-amino-isobutyric acid
  MOD_RES (20)..(20): C-terminal amidation
FQSKPNVHVDGYFERLXAKL

SEQ ID NO: 4076 - protein, 20 aa, Artificial Sequence
  Synthetic peptide
  MOD_RES (1)..(1): N-terminal acetylation
  MOD_RES (5)..(5): D-Pro
  MOD_RES (12)..(12): 4-methoxy Phe
  MOD_RES (17)..(17): Xaa is 2-amino-isobutyric acid
  MOD_RES (20)..(20): C-terminal amidation
FQSKPNVHVDGFFERLXAKL

SEQ ID NO: 4077 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): C-terminal amidation
FQSKPNVHVDGTFERLXAKLC

SEQ ID NO: 4078 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVDGYFERLXAKLC

SEQ ID NO: 4079 - protein, 22 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Xaa is N-(3-{2-[2-(3-Amino-propoxy)-ethoxy]-ethoxy}-propyl)-succinamic acid
  MOD_RES (22)..(22): Lys modified with biotinyl
  MOD_RES (22)..(22): C-terminal amidation
FQSKPNVHVDGYFERLXAKLXK

SEQ ID NO: 4080 - protein, 20 aa, Artificial Sequence
  Synthetic peptide
  MOD_RES (1)..(1): N-terminal acetylation
  MOD_RES (3)..(3): Xaa is 2-amino-isobutyric acid
  MOD_RES (14)..(14): D-Pro
  MOD_RES (20)..(20): C-terminal amidation
VFXEVLKFGHALKPNSQDRY

SEQ ID NO: 4081 - protein, 20 aa, Artificial Sequence
  Synthetic peptide
  MOD_RES (1)..(1): N-terminal acetylation
  MOD_RES (2)..(2): D-Pro
  MOD_RES (8)..(8): Xaa is 2-amino-isobutyric acid
  MOD_RES (20)..(20): C-terminal amidation
FPDYVERXKGFLVHQKLASN

SEQ ID NO: 4082 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (4)..(4): Xaa is 2-amino-isobutyric acid
  MOD_RES (15)..(15): D-Pro
  MOD_RES (21)..(21): C-terminal amidation
XVFXEVLKFGHALKPNSQDRY

SEQ ID NO: 4083 - protein, 21 aa, Artificial Sequence
  Synthetic peptide
  MOD_RES (1)..(1): N-terminal biotinyl
  MOD_RES (1)..(1): Xaa is N-(3-{2-[2-(3-Amino-propoxy)-ethoxy]-ethoxy}-propyl)-succinamic acid
  MOD_RES (3)..(3): D-Pro
  MOD_RES (9)..(9): Xaa is 2-amino-isobutyric acid
  MOD_RES (21)..(21): C-terminal amidation
XFPDYVERXKGFLVHQKLASN

SEQ ID NO: 4084 - protein, 22 aa, Artificial Sequence
  Synthetic peptide
  MOD_RES (1)..(1): N-terminal acetylation
  MOD_RES (3)..(3): Xaa is 2-amino-isobutyric acid
  MOD_RES (14)..(14): D-Pro
  MOD_RES (21)..(21): Xaa is N-(3-{2-[2-(3-Amino-propoxy)-ethoxy]-ethoxy}-propyl)-succinamic acid
  MOD_RES (22)..(22): Lys modifed with biotinyl
  MOD_RES (22)..(22): C-terminal amidation
VFXEVLKFGHALKPNSQDRYXK

SEQ ID NO: 4085 - protein, 22 aa, Artificial Sequence
  Synthetic peptide
  MOD_RES (1)..(1): N-terminal acetylation
  MOD_RES (2)..(2): D-Pro
  MOD_RES (8)..(8): Xaa is 2-amino-isobutyric acid
  MOD_RES (21)..(21): Xaa is N-(3-{2-[2-(3-Amino-propoxy)-ethoxy]-ethoxy}-propyl)-succinamic acid
  MOD_RES (22)..(22): Lys modified with biotinyl
  MOD_RES (22)..(22): C-terminal amidation
FPDYVERXKGFLVHQKLASNXK

SEQ ID NO: 4086 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Cys-PEG
  MOD_RES (21)..(21): C-terminal amidation
FQSKPNVHVDGYFERLXAKLC

SEQ ID NO: 4087 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Cys-PEG
  MOD_RES (21)..(21): C-terminal amidation
FQSKPNVHVDGYFERLXAKLC

SEQ ID NO: 4088 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Cys-PEG
  MOD_RES (21)..(21): C-terminal amidation
FQSKPNVHVDGYFERLXAKLC

SEQ ID NO: 4089 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Cys-PEG
  MOD_RES (21)..(21): C-terminal amidation
FQSKPNVHVDGYFERLXAKLC

SEQ ID NO: 4090 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Cys-PEG
  MOD_RES (21)..(21): C-terminal amidation
FQSKPNVHVDGYFERLXAKLC

SEQ ID NO: 4091 - protein, 20 aa, Artificial Sequence
  Synthetic peptide
  MOD_RES (1)..(1): N-terminal acetylation
  MOD_RES (1)..(1): Benzothienyl-Ala
  MOD_RES (5)..(5): D-Pro
  MOD_RES (13)..(13): 1-naphtyl-Ala
  MOD_RES (17)..(17): 2-amino-isobutyric acid
  MOD_RES (20)..(20): C-terminal amidation
AQSKPNVHVDGYAERLXAKL

SEQ ID NO: 4092 - protein, 20 aa, Artificial Sequence
  Synthetic peptide
  MOD_RES (1)..(1): N-terminal acetylation
  MOD_RES (1)..(1): Benzothienyl-Ala
  MOD_RES (5)..(5): D-Pro
  MOD_RES (13)..(13): Benzothienyl-Ala
  MOD_RES (17)..(17): Xaa is 2-amino-isobutyric acid
  MOD_RES (20)..(20): C-terminal amidation
AQSKPNVHVDGYAERLXAKL

SEQ ID NO: 4093 - protein, 20 aa, Artificial Sequence
  Synthetic peptide
  MOD_RES (1)..(1): N-terminal acetylation
  MOD_RES (1)..(1): 1-naphtyl-Ala
  MOD_RES (5)..(5): D-Pro
  MOD_RES (13)..(13): 1-naphtyl-Ala
  MOD_RES (17)..(17): Xaa is 2-amino-isobutyric acid
  MOD_RES (20)..(20): C-terminal amidation
AQSKPNVHVDGYAERLXAKL

SEQ ID NO: 4094 - protein, 20 aa, Artificial Sequence
  Synthetic peptide
  MOD_RES (1)..(1): N-terminal acetylation
  MOD_RES (1)..(1): 1-naphtyl-Ala
  MOD_RES (5)..(5): D-Pro
  MOD_RES (13)..(13): Benzothienyl-Ala
  MOD_RES (17)..(17): Xaa is 2-amino-isobutyric acid
  MOD_RES (20)..(20): C-terminal amidation
AQSKPNVHVDGYAERLXAKL

SEQ ID NO: 4095 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPNVHVCGYFERLXAKL

SEQ ID NO: 4096 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPNVHVDGYCERLXAKL

SEQ ID NO: 4097 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPNVHVDGYFCRLXAKL

SEQ ID NO: 4098 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Lys((N-(3-{2-[2-(3-Amino-propoxy)-ethoxy]-ethoxy}-propyl)-succina mic acid)-3-maleiimidopropionyl)-OH
  MOD_RES (21)..(21): C-terminal amidation
FQSKPNVHVDGYFERLXAKLK

SEQ ID NO: 4099 - protein, 23 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (23)..(23): 2-Amino-6-(2-aminooxy-acetylamino)-hexanoic acid
  MOD_RES (23)..(23): C-terminal amidation
FQSKPNVHVDGYFERLAIBAKLK

SEQ ID NO: 4100 - protein, 21 aa, Artificial Sequence
  Synthetic peptide
  MOD_RES (1)..(1): N-terminal acetylation
  MOD_RES (5)..(5): D-Pro
  MOD_RES (9)..(9): Xaa is 2-aminobutyric acid
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHXDGYFERLXAKLC

SEQ ID NO: 4101 - protein, 21 aa, Artificial Sequence
  Synthetic peptide
  MOD_RES (1)..(1): N-terminal aceytlation
  MOD_RES (5)..(5): D-Pro
  MOD_RES (9)..(9): Xaa is L-2-Amino-4,4,4-trifluorobutyric acid
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHXDGYFERLXAKLC

SEQ ID NO: 4102 - protein, 21 aa, Artificial Sequence
  Synthetic peptide
  MOD_RES (1)..(1): N-terminal acetylation
  MOD_RES (5)..(5): D-Pro
  MOD_RES (9)..(9): Cyclopentyl Gly
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHGDGYFERLXAKLC

SEQ ID NO: 4103 - protein, 21 aa, Artificial Sequence
  Synthetic peptide
  MOD_RES (1)..(1): N-terminal acetylation
  MOD_RES (5)..(5): D-Pro
  MOD_RES (9)..(9): D-Val
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVDGYFERLXAKLC

SEQ ID NO: 4104 - protein, 21 aa, Artificial Sequence
  Synthetic peptide
  MOD_RES (1)..(1): N-terminal acetylation
  MOD_RES (5)..(5): D-Pro
  MOD_RES (9)..(9): Xaa is 2-amino-isobutyric acid
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHXDGYFERLXAKLC

SEQ ID NO: 4105 - protein, 21 aa, Artificial Sequence
  Synthetic peptide
  MOD_RES (1)..(1): N-terminal amidation
  MOD_RES (5)..(5): D-Pro
  MOD_RES (9)..(9): Tert-Leu
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHLDGYFERLXAKLC

SEQ ID NO: 4106 - protein, 21 aa, Artificial Sequence
  Synthetic peptide
  MOD_RES (1)..(1): N-terminal acetylation
  MOD_RES (5)..(5): D-Pro
  MOD_RES (9)..(9): N-methyl-Val
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVDGYFERLXAKLC

SEQ ID NO: 4107 - protein, 21 aa, Artificial Sequence
  Synthetic peptide
  MOD_RES (1)..(1): N-terminal acetylation
  MOD_RES (5)..(5): D-Pro
  MOD_RES (10)..(10): N-methyl-Asp
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVDGYFERLXAKLC

SEQ ID NO: 4108 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVHGYFERLXAKLC

SEQ ID NO: 4109 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVSGYFERLXAKLC

SEQ ID NO: 4110 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVTGYFERLXAKLC

SEQ ID NO: 4111 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVPGYFERLXAKLC

SEQ ID NO: 4112 - protein, 21 aa, Artificial Sequence
  Synthetic peptide
  MOD_RES (1)..(1): N-terminal acetylation
  MOD_RES (5)..(5): D-Pro
  MOD_RES (10)..(10): D-Asp
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVDGYFERLXAKLC

SEQ ID NO: 4113 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHLPGYFERLXAKLC

SEQ ID NO: 4114 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHLTGYFERLXAKLC

SEQ ID NO: 4115 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPNVHVDAYFERLXAKLC

SEQ ID NO: 4116 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-ethylmaleiimido Cys
  MOD_RES (17)..(17): Xaa is 2-amino-isobutyric acid
  MOD_RES (20)..(20): C-terminal amidation
FQSKPCVHVDGYFERLXAKL

SEQ ID NO: 4117 - protein, 20 aa, Artificial Sequence
  Synthetic peptide
  MOD_RES (1)..(1): N-terminal acetylation
  MOD_RES (5)..(5): D-Pro
  MOD_RES (10)..(10): N-ethylmaleiimido Cys
  MOD_RES (17)..(17): Xaa is 2-amino-isobutyric acid
  MOD_RES (20)..(20): C-terminal amidation
FQSKPNVHVCGYFERLXAKL

SEQ ID NO: 4118 - protein, 20 aa, Artificial Sequence
  Synthetic peptide
  MOD_RES (1)..(1): N-terminal aceytlation
  MOD_RES (5)..(5): D-Pro
  MOD_RES (14)..(14): N-ethylmaleiimido Cys
  MOD_RES (17)..(17): Xaa is 2-amino-isobutyric acid
  MOD_RES (20)..(20): C-terminal amidation
FQSKPNVHVDGYFCRLXAKL

SEQ ID NO: 4119 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Lys is covalently bound to N-(3-{2-[2-(3-Amino-propoxy)-ethoxy]-ethoxy}-propyl)-succinamic acid-Maleimidopropionyl(EtSH)
  MOD_RES (21)..(21): C-terminal amidation
FQSKPNVHVDGYFERLXAKLK

SEQ ID NO: 4120 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): PEGYLATION (Y-MAL-40K)
  MOD_RES (21)..(21): Cys-PEG (Mal-40kDa)
  MOD_RES (21)..(21): C-terminal amidation
FQSKPNVHVDGYFERLXAKLC

SEQ ID NO: 4121 - protein, 20 aa, Artificial Sequence
  Synthetic peptide
  MOD_RES (1)..(1): N-terminal acetylation
  MOD_RES (5)..(5): D-Pro
  MOD_RES (6)..(6): Cys-PEG (ME-400MA)
  MOD_RES (17)..(17): Xaa is 2-amino-isobutyric acid
  MOD_RES (20)..(20): C-terminal amidation
FQSKPCVHVDGYFERLXAKL

SEQ ID NO: 4122 - protein, 20 aa, Artificial Sequence
  Synthetic peptide
  MOD_RES (1)..(1): N-terminal acetylation
  MOD_RES (5)..(5): D-Pro
  MOD_RES (10)..(10): Cys-PEG (ME-400MA)
  MOD_RES (17)..(17): Xaa is 2-amino-isobutyric acid
  MOD_RES (20)..(20): C-terminal amidation
FQSKPNVHVCGYFERLXAKL

SEQ ID NO: 4123 - protein, 20 aa, Artificial Sequence
  Synthetic peptide
  MOD_RES (1)..(1): N-terminal amidation
  MOD_RES (5)..(5): D-Pro
  MOD_RES (14)..(14): Cys-PEG (ME-400MA)
  MOD_RES (17)..(17): Xaa is 2-amino-isobutyric acid
  MOD_RES (20)..(20): C-terminal amidation
FQSKPNVHVDGYFCRLXAKL

SEQ ID NO: 4124 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Xaa is 3-[2-(2-{2-[2-(2-Amino-ethoxy)-ethoxy]-ethoxy}-ethoxy)-ethoxy]-pr opionic acid
  MOD_RES (21)..(21): C-terminal amidation
FQSKPNVHVDGYFERLXAKLX

SEQ ID NO: 4125 - protein, 21 aa, Artificial Sequence
  Synthetic peptide
  MOD_RES (1)..(1): N-terminal amidation
  MOD_RES (5)..(5): D-Pro
  MOD_RES (17)..(17): Xaa is 2-amino-isobutyric acid
  MOD_RES (21)..(21): Xaa is 3-(2-{2-[2-(2-Amino-ethoxy)-ethoxy]-ethoxy}-ethoxy)-propionic acid
  MOD_RES (21)..(21): C-terminal amidation
FQSKPNVHVDGYFERLXAKLX

SEQ ID NO: 4126 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Xaa is 3-{2-[2-(2-Amino-ethoxy)-ethoxy]-ethoxy}-propionic acid
  MOD_RES (21)..(21): C-terminal amidation
FQSKPNVHVDGYFERLXAKLX

SEQ ID NO: 4127 - protein, 21 aa, Artificial Sequence
  Synthetic peptide
  MOD_RES (1)..(1): N-terminal aceytlation
  MOD_RES (5)..(5): D-Pro
  MOD_RES (17)..(17): Xaa is 2-amino-isobutyric acid
  MOD_RES (21)..(21): Xaa is [2-(2-Amino-ethoxy)-ethoxy]-acetic acid
  MOD_RES (21)..(21): C-terminal amidation
FQSKPNVHVDGYFERLXAKLX

SEQ ID NO: 4128 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Cys(20 kDa PSA)
  MOD_RES (21)..(21): C-terminal amidation
FQSKPNVHVDGYFERLXAKLC

SEQ ID NO: 4129 - protein, 21 aa, Artificial Sequence
  Synthetic peptide
  MOD_RES (1)..(1): N-terminal aceytlation
  MOD_RES (5)..(5): D-Pro
  MOD_RES (17)..(17): Xaa is 2-amino-isobutyric acid
  MOD_RES (21)..(21): Cys is covalently bound to N-(3-{2-[2-(3-Amino-propoxy)-ethoxy]-ethoxy}-propyl)-succinamic acid - Maleimid-HSA
  MOD_RES (21)..(21): C-terminal amidation
FQSKPNVHVDGYFERLXAKLK

SEQ ID NO: 4130 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPKVHLDGYFERLXAKL

SEQ ID NO: 4131 - protein, 20 aa, Artificial Sequence
  Synthetic peptide
  MOD_RES (1)..(1): N-terminal acetylation
  MOD_RES (5)..(5): D-Pro
  MOD_RES (6)..(6): Xaa is Citrulline
  MOD_RES (9)..(9): Tert-Leu
  MOD_RES (17)..(17): Xaa is 2-amino-isobutyric acid
  MOD_RES (20)..(20): C-terminal amidation
FQSKPXVHLDGYFERLXAKL

SEQ ID NO: 4132 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPVVHLDGYFERLXAKL

SEQ ID NO: 4133 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4134 - protein, 20 aa, Artificial Sequence
  Synthetic peptide
  MOD_RES (1)..(1): N-terminal acetylation
  MOD_RES (5)..(5): D-Pro
  MOD_RES (6)..(6): 3-(Acetylamino-methylsulfanyl)-2-amino-propionic acid
  MOD_RES (9)..(9): Tert-Leu
  MOD_RES (17)..(17): Xaa is 2-amino-isobutyric acid
  MOD_RES (20)..(20): C-terminal amidation
FQSKPCVHLDGYFERLXAKL

SEQ ID NO: 4135 - protein, 20 aa, Artificial Sequence
  Synthetic peptide
  MOD_RES (1)..(1): N-terminal acetylation
  MOD_RES (5)..(5): D-Pro
  MOD_RES (6)..(6): Xaa is Norleucine
  MOD_RES (9)..(9): Tert-Leu
  MOD_RES (17)..(17): Xaa is 2-amino-isobutyric acid
  MOD_RES (20)..(20): C-terminal amidation
FQSKPXVHLDGYFERLXAKL

SEQ ID NO: 4136 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPRVHLDGYFERLXAKL

SEQ ID NO: 4137 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPSVHLDGYFERLXAKL

SEQ ID NO: 4138 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPIVHLDGYFERLXAKL

SEQ ID NO: 4139 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): N-methyl-Gly
  MOD_RES (17)..(17): Xaa is 2-amino-isobutyric acid
  MOD_RES (20)..(20): C-terminal amidation
FQSKPNVHLDGYFERLXAKL

SEQ ID NO: 4140 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Pro
  MOD_RES (17)..(17): Xaa is 2-amino-isobutyric acid
  MOD_RES (20)..(20): C-terminal amidation
FQSKPNVHLDPYFERLXAKL

SEQ ID NO: 4141 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPNVHLDGYFERLXLKL

SEQ ID NO: 4142 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (18)..(18): Xaa is norleucine
  MOD_RES (20)..(20): C-terminal amidation
FQSKPNVHLDGYFERLXXKL

SEQ ID NO: 4143 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (19)..(19): N-methyl-Lys
  MOD_RES (20)..(20): C-terminal amidation
FQSKPNVHLDGYFERLXAKL

SEQ ID NO: 4144 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQDKPNVHLDGYFERLXAKL

SEQ ID NO: 4145 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQEKPNVHLDGYFERLXAKL

SEQ ID NO: 4146 - protein, 16 aa, Artificial Sequence
  Synthetic peptide
  MOD_RES (1)..(1): N-terminal acetylation
  MOD_RES (5)..(5): Tert-Leu
  MOD_RES (13)..(13): Xaa is 2-amino-isobutyric acid
  MOD_RES (16)..(16): C-terminal amidation
FQVHLDGYFERLXAKL

SEQ ID NO: 4147 - protein, 16 aa, Artificial Sequence
  Synthetic peptide
  MOD_RES (1)..(1): N-terminal acetylation
  MOD_RES (2)..(2): D-Gln
  MOD_RES (5)..(5): Tert-Leu
  MOD_RES (13)..(13): Xaa is 2-amino-isobutyric acid
  MOD_RES (16)..(16): C-terminal amidation
FQVHLDGYFERLXAKL

SEQ ID NO: 4148 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Lys(PSA)
  MOD_RES (21)..(21): C-terminal amidation
FQSKPNVHVDGYFERLXAKLK

SEQ ID NO: 4149 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (17)..(17): Xaa is 2-amino-isobutyric acid
  MOD_RES (20)..(20): C-terminal amidation
FQSKPNVHLDGYFERLXAKL

SEQ ID NO: 4150 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPNVHVPGYFERLXAKL

SEQ ID NO: 4151 - protein, 20 aa, Artificial Sequence
  Synthetic peptide
  MOD_RES (1)..(1): N-terminal acetylation
  MOD_RES (5)..(5): D-Pro
  MOD_RES (11)..(11): D-Ala
  MOD_RES (17)..(17): Xaa is 2-amino-isobutyric acid
  MOD_RES (20)..(20): C-terminal amidation
FQSKPNVHVPAYFERLXAKL

SEQ ID NO: 4152 - protein, 20 aa, Artificial Sequence
  Synthetic peptide
  MOD_RES (1)..(1): N-terminal acetylation
  MOD_RES (5)..(5): D-Pro
  MOD_RES (14)..(14): Xaa is 2-amino-isobutyric acid
  MOD_RES (17)..(17): Xaa is 2-amino-isobutyric acid
  MOD_RES (20)..(20): C-terminal amidation
FQSKPNVHVPGYFXRLXAKL

SEQ ID NO: 4153 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-aminoindane-2-carboxylic acid
  MOD_RES (20)..(20): C-terminal amidation
FQSKPNVHLDAYFERLXAKL

SEQ ID NO: 4154 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 1-amino-cyclopentane carboxylic acid
  MOD_RES (20)..(20): C-terminal amidation
FQSKPNVHLDAYFERLXAKL

SEQ ID NO: 4155 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 3-aminopentane-3-carboxylic acid
  MOD_RES (20)..(20): C-terminal amidation
FQSKPNVHLDAYFERLXAKL

SEQ ID NO: 4156 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (18)..(18): Xaa is 2-amino-isobutyric acid
  MOD_RES (20)..(20): C-terminal amidation
FQSKPNVHLDAYFERLXXKL

SEQ ID NO: 4157 - protein, 20 aa, Artificial Sequence
  Synthetic peptide
  MOD_RES (1)..(1): N-terminal acetylation
  MOD_RES (5)..(5): D-Pro
  MOD_RES (8)..(8): 2-naphthyl Ala
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVALDAYFERLXAKL

SEQ ID NO: 4158 - protein, 20 aa, Artificial Sequence
  Synthetic peptide
  MOD_RES (1)..(1): N-terminal palmitoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4159 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (16)..(16): Homo-Cys
  MOD_RES (17)..(17): Xaa is 2-amino-isobutyric acid
  MOD_RES (20)..(20): Homo-Cys
  MOD_RES (20)..(20): C-terminal amidation
FQSKPNVHLDAYFERCXAKC

SEQ ID NO: 4160 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQCKPCVHLDAYFERLXAKL

SEQ ID NO: 4161 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (16)..(16): Homo-Leu
  MOD_RES (17)..(17): Xaa is 2-amino-isobutyric acid
  MOD_RES (20)..(20): C-terminal amidation
FQSKPNVHLDAYFERLXAKL

SEQ ID NO: 4162 - protein, 20 aa, Artificial Sequence
  Synthetic peptide
  MOD_RES (1)..(1): N-terminal acetylation
  MOD_RES (5)..(5): D-Pro
  MOD_RES (7)..(7): Tert-Leu
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNLHLDAYFERLXAKL

SEQ ID NO: 4163 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (19)..(19): Homo-Arg
  MOD_RES (20)..(20): C-terminal amidation
FQSKPNVHLDAYFERLXARL

SEQ ID NO: 4164 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (19)..(19): Xaa is Orn(pyrazinylcarbonyl)-OH
  MOD_RES (20)..(20): C-terminal amidation
FQSKPNVHLDAYFERLXAXL

SEQ ID NO: 4165 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (18)..(18): Xaa is 2-amino-isobutyric acid
  MOD_RES (20)..(20): C-terminal amidation
FQSKPNVHLDAYFERLAXKL

SEQ ID NO: 4166 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): D-Ala
  MOD_RES (18)..(18): Xaa is 2-amino-isobutyric acid
  MOD_RES (20)..(20): C-terminal amidation
FQSKPNVHLDAYFERLAXKL

SEQ ID NO: 4167 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (14)..(14): Homo-Cys
  MOD_RES (18)..(18): Homo-Cys
  MOD_RES (20)..(20): C-terminal amidation
FQSKPNVHLDAYFCRLACKL

SEQ ID NO: 4168 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPEVHLDAYFERLXAKL

SEQ ID NO: 4169 - protein, 20 aa, Artificial Sequence
  Synthetic peptide
  MOD_RES (1)..(1): N-terminal acetylation
  MOD_RES (5)..(5): D-Pro
  MOD_RES (6)..(6): Sulfoxid of carboxyethyl Cys
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPCVHLDAYFERLXAKL

SEQ ID NO: 4170 - protein, 20 aa, Artificial Sequence
  Synthetic peptide
  MOD_RES (1)..(1): N-terminal acetylation
  MOD_RES (3)..(3): Sulfoxid of carboxyethyl Cys
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQCKPNVHLDAYFERLXAKL

SEQ ID NO: 4171 - protein, 21 aa, Artificial Sequence
  Synthetic peptide
  MOD_RES (1)..(1): Carboxyfluoresceine
  MOD_RES (1)..(1): Xaa is N-(3-{2-[2-(3-Amino-propoxy)-ethoxy]-ethoxy}-propyl)-succinamic acid
  MOD_RES (6)..(6): D-Pro
  MOD_RES (18)..(18): Xaa is 2-amino-isobutyric acid
  MOD_RES (21)..(21): C-terminal amidation
XFQSKPNVHVDGYFERLXAKL

SEQ ID NO: 4172 - protein, 21 aa, Artificial Sequence
  Synthetic peptide
  MOD_RES (1)..(1): Carboxyfluoresceine
  MOD_RES (1)..(1): Xaa is N-(3-{2-[2-(3-Amino-propoxy)-ethoxy]-ethoxy}-propyl)-succinamic acid
  MOD_RES (4)..(4): Xaa is 2-amino-isobutyric acid
  MOD_RES (15)..(15): D-Pro
  MOD_RES (21)..(21): C-terminal amidation
XVFXEVLKFGHALKPNSQDRY

SEQ ID NO: 4173 - protein, 20 aa, Artificial Sequence
  Synthetic peptide
  MOD_RES (1)..(1): N-terminal phenyl acetyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4174 - protein, 20 aa, Artificial Sequence
  Synthetic peptide
  MOD_RES (1)..(1): N-terminal 3-phenyl propionyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4175 - protein, 20 aa, Artificial Sequence
  Synthetic peptide
  MOD_RES (1)..(1): N-terminal 2-(naphth-2-yl) acetyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4176 - protein, 20 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4177 - protein, 20 aa, Artificial Sequence
  Synthetic peptide
  MOD_RES (1)..(1): N-terminal 2-methyl propionyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4178 - protein, 20 aa, Artificial Sequence
  Synthetic peptide
  MOD_RES (1)..(1): N-terminal 3-methyl butanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4179 - protein, 20 aa, Artificial Sequence
  Synthetic peptide
  MOD_RES (1)..(1): N-terminal 2-naphthyl sulfonyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4180 - protein, 20 aa, Artificial Sequence
  Synthetic peptide
  MOD_RES (1)..(1): N-terminal 1-naphthyl sulfonyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4181 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MISC_FEATURE (18)..(20): Cys and 2-amino-ethanathiol linked via disulfide bond
  MOD_RES (21)..(21): Xaa is 2-amino-ethanethiol
FQSKPNVHLDAYFERLXCKLX

SEQ ID NO: 4182 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (18)..(18): D-Cys
  MISC_FEATURE (18)..(21): Cys and 2-amino-ethanathiol linked via disulfide bond
  MOD_RES (21)..(21): Xaa is 2-amino-ethanethiol
FQSKPNVHLDAYFERLXCKLX

SEQ ID NO: 4183 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MISC_FEATURE (17)..(21): Cys and 2-amino-ethanathiol linked via disulfide bond
  MOD_RES (21)..(21): Xaa is 2-amino-ethanethiol
FQSKPNVHLDAYFERLCAKLX

SEQ ID NO: 4184 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): D-Cys
  MOD_RES (21)..(21): Xaa is 2-amino-ethanethiol
  MISC_FEATURE (21)..(21): Cys and 2-amino-ethanathiol linked via disulfide bond
FQSKPNVHLDAYFERLCAKLX

SEQ ID NO: 4185 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): Alpha-methyl-Leu
  MOD_RES (20)..(20): C-terminal amidation
FQSKPNVHLDAYFERLXAKL

SEQ ID NO: 4186 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (16)..(16): Alpha-methyl-Leu
  MOD_RES (20)..(20): C-terminal amidation
FQSKPNVHLDAYFERLAAKL

SEQ ID NO: 4187 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXLKL

SEQ ID NO: 4188 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (14)..(14): Xaa is 2-amino-isobutyric acid
  MOD_RES (17)..(17): Xaa is 2-amino-isobutyric acid
  MOD_RES (20)..(20): C-terminal amidation
FQSKPNVHLDAYFXRLXLKL

SEQ ID NO: 4189 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (14)..(14): Xaa is 2-amino-isobutyric acid
  MOD_RES (17)..(17): Xaa is 2-amino-isobutyric acid
  MOD_RES (20)..(20): C-terminal amidation
FQSKPNVHLDAYFXRLXAKL

SEQ ID NO: 4190 - protein, 20 aa, Artificial Sequence
  Synthetic peptide
  MOD_RES (1)..(1): N-terminal acetylation
  MOD_RES (5)..(5): D-Pro
  MOD_RES (11)..(11): D-Ala
  MOD_RES (14)..(14): Xaa is 2-amino-isobutyric acid
  MOD_RES (17)..(17): Xaa is 2-amino-isobutyric acid
  MOD_RES (20)..(20): C-terminal amidation
FQSKPNVHVPAYFXRLXAKL

SEQ ID NO: 4191 - protein, 20 aa, Artificial Sequence
  Synthetic peptide
  MOD_RES (1)..(1): N-terminal acetylation
  MOD_RES (5)..(5): D-Pro
  MOD_RES (11)..(11): D-Ala
  MOD_RES (17)..(17): Xaa is 2-amino-isobutyric acid
  MOD_RES (20)..(20): C-terminal amidation
FQSKPNVHVPAYFERLXLKL

SEQ ID NO: 4192 - protein, 20 aa, Artificial Sequence
  Synthetic peptide
  MOD_RES (1)..(1): N-terminal acetylation
  MOD_RES (5)..(5): D-Pro
  MOD_RES (11)..(11): D-Ala
  MOD_RES (14)..(14): Xaa is 2-amino-isobutyric acid
  MOD_RES (17)..(17): Xaa is 2-amino-isobutyric acid
  MOD_RES (20)..(20): C-terminal amidation
FQSKPNVHVPAYFXRLXLKL

SEQ ID NO: 4193 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (12)..(12): 3,4-dihydroxy Phe
  MOD_RES (17)..(17): Xaa is 2-amino-isobutyric acid
  MOD_RES (20)..(20): C-terminal amidation
FQSKPNVHLDAFFERLXAKL

SEQ ID NO: 4194 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
YQSKPNVHLDAYFERLXAKL

SEQ ID NO: 4195 - protein, 20 aa, Artificial Sequence
  Synthetic peptide
  MOD_RES (1)..(1): N-terminal acetylation
  MOD_RES (1)..(1): 3,4-dihydroxy Phe
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVHLDAYFERLXAKL

SEQ ID NO: 4196 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-ethylmaleiimido Cys
  MOD_RES (9)..(9): Tert-Leu
  MOD_RES (11)..(11): D-Ala
  MOD_RES (13)..(13): Benzothienyl-Ala
  MOD_RES (17)..(17): Xaa is 2-amino-isobutyric acid
  MOD_RES (20)..(20): C-terminal amidation
FQSKPCVHLDAYAERLXAKL

SEQ ID NO: 4197 - protein, 20 aa, Artificial Sequence
  Synthetic peptide
  MOD_RES (1)..(1): N-terminal acetylation
  MOD_RES (5)..(5): Xaa is D-octahydro-indole-2-carboxylic acid
  MOD_RES (6)..(6): N-ethylmaleiimido Cys
  MOD_RES (9)..(9): Tert-Leu
  MOD_RES (11)..(11): D-Ala
  MOD_RES (13)..(13): Benzothienyl-Ala
  MOD_RES (17)..(17): Xaa is 2-amino-isobutyric acid
  MOD_RES (20)..(20): C-terminal amidation
FQSKXCVHLDAYAERLXAKL

SEQ ID NO: 4198 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-ethylmaleiimido Cys
  MOD_RES (11)..(11): D-Ala
  MOD_RES (13)..(13): Benzothienyl-Ala
  MOD_RES (17)..(17): Xaa is 2-amino-isobutyric acid
  MOD_RES (20)..(20): C-terminal amidation
FQSKPCVHVPAYAERLXAKL

SEQ ID NO: 4199 - protein, 20 aa, Artificial Sequence
  Synthetic peptide
  MOD_RES (1)..(1): N-terminal acetylation
  MOD_RES (5)..(5): Xaa is D-octahydro-indole-2-carboxylic acid
  MOD_RES (6)..(6): N-ethylmaleiimido Cys
  MOD_RES (11)..(11): D-Ala
  MOD_RES (13)..(13): Benzothienyl-Ala
  MOD_RES (17)..(17): Xaa is 2-amino-isobutyric acid
  MOD_RES (20)..(20): C-terminal amidation
FQSKXCVHVPAYAERLXAKL

SEQ ID NO: 4200 - protein, 20 aa, Artificial Sequence
  Synthetic peptide
  MOD_RES (1)..(1): N-terminal acetylation
  MOD_RES (5)..(5): D-Pro
  MOD_RES (8)..(8): 4-methoxy Phe
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVFLDAYFERLXAKL

SEQ ID NO: 4201 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNTHLDAYFERLXAKL

SEQ ID NO: 4202 - protein, 20 aa, Artificial Sequence
  Synthetic peptide
  MOD_RES (1)..(1): N-terminal acetylation
  MOD_RES (5)..(5): D-Pro
  MOD_RES (6)..(6): Carboxymethyl Cys
  MOD_RES (9)..(9): Tert-Leu
  MOD_RES (11)..(11): D-Ala
  MOD_RES (17)..(17): Xaa 2-amino-isobutyric acid
  MOD_RES (20)..(20): C-terminal amidation
FQSKPCVHLDAYFERLXAKL

SEQ ID NO: 4203 - protein, 20 aa, Artificial Sequence
  Synthetic peptide
  MOD_RES (1)..(1): N-terminal acetylation
  MOD_RES (3)..(3): Carboxymethyl Cys
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQCKPNVHLDAYFERLXAKL

SEQ ID NO: 4204 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (14)..(14): Homo-Cys
  MISC_FEATURE (14)..(18): Homo-Cys linked via disulfide bond
  MOD_RES (17)..(17): Xaa is 2-amino-isobutyric acid
  MOD_RES (18)..(18): Homo-Cys
  MOD_RES (20)..(20): C-terminal amidation
FQSKPNVHLDAYFCRLXCKL

SEQ ID NO: 4205 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (14)..(14): D-Cys
  MISC_FEATURE (14)..(18): D-Cys and Homo-Cys linked via disulfide bond
  MOD_RES (18)..(18): Homo-Cys
  MOD_RES (20)..(20): C-terminal amidation
FQSKPNVHLDAYFCRLACKL

SEQ ID NO: 4206 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MISC_FEATURE (14)..(18): Cys and Homo-Cys linked via disulfide bond
  MOD_RES (18)..(18): Homo-Cys
  MOD_RES (20)..(20): C-terminal amidation
FQSKPNVHLDAYFCRLACKL

SEQ ID NO: 4207 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (14)..(14): D-Cys
  MISC_FEATURE (14)..(17): D-Cys and Cys linked via disulfide bond
  MOD_RES (20)..(20): C-terminal amidation
FQSKPNVHLDAYFCRLCAKL

SEQ ID NO: 4208 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MISC_FEATURE (14)..(17): Cys linked via disulfide bond
  MOD_RES (20)..(20): C-terminal amidation
FQSKPNVHLDAYFCRLCAKL

SEQ ID NO: 4209 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Cys
  MISC_FEATURE (11)..(14): D-Cys and Homo-Cys linked via disulfide bond
  MOD_RES (14)..(14): Homo-Cys
  MOD_RES (17)..(17): Xaa is 2-amino-isobutyric acid
  MOD_RES (20)..(20): C-terminal amidation
FQSKPNVHLDCYFCRLXAKL

SEQ ID NO: 4210 - protein, 20 aa, Artificial Sequence
  Synthetic peptide
  MOD_RES (1)..(1): N-terminal amidation
  MOD_RES (5)..(5): D-Pro
  MOD_RES (9)..(9): Tert-Leu
  MOD_RES (11)..(11): D-Cys
  MISC_FEATURE (11)..(14): D-Cys and Cys linked via disulfide bond
  MOD_RES (17)..(17): Xaa is 2-amino-isobutyric acid
  MOD_RES (20)..(20): C-terminal amidation
FQSKPNVHLDCYFCRLXAKL

SEQ ID NO: 4211 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Amidation
  MOD_RES (21)..(21): Cys is covalently bound to Ttds-maleiimidopropionyl of the C-terminus of SEQ ID NO: 4119 to form a dimer
FQSKPNVHVDGYFERLXAKLC

SEQ ID NO: 4212 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): Homo-Cys
  MISC_FEATURE (11)..(14): Homo-Cys linked via disulfide bond
  MOD_RES (14)..(14): Homo-Cys
  MOD_RES (17)..(17): Xaa is 2-amino-isobutyric acid
  MOD_RES (20)..(20): C-terminal amidation
FQSKPNVHLDCYFCRLXAKL

SEQ ID NO: 4213 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): Homo-Cys
  MISC_FEATURE (11)..(14): Homo-Cys and Cys linked via disulfide bond
  MOD_RES (17)..(17): Xaa is 2-amino-isobutyric acid
  MOD_RES (20)..(20): C-terminal amidation
FQSKPNVHLDCYFCRLXAKL

SEQ ID NO: 4214 - protein, 20 aa, Artificial Sequence
  Synthetic peptide
  MOD_RES (1)..(1): N-terminal acetylation
  MOD_RES (5)..(5): D-Pro
  MOD_RES (11)..(11): D-Cys
  MISC_FEATURE (11)..(14): D-Cys and Homo-Cys linked via disulfide bond
  MOD_RES (14)..(14): Homo-Cys
  MOD_RES (17)..(17): Xaa is 2-amino-isobutyric acid
  MOD_RES (20)..(20): C-terminal amidation
FQSKPNVHVPCYFCRLXAKL

SEQ ID NO: 4215 - protein, 20 aa, Artificial Sequence
  Synthetic peptide
  MOD_RES (1)..(1): N-terminal aceytlation
  MOD_RES (5)..(5): D-Pro
  MOD_RES (9)..(9): Tert-Leu
  MOD_RES (11)..(11): D-Cys
  MISC_FEATURE (11)..(14): D-Cys and Homo-Cys linked via disulfide bond
  MOD_RES (13)..(13): Benzothienyl-Ala
  MOD_RES (14)..(14): Homo-Cys
  MOD_RES (17)..(17): Xaa is 2-amino-isobutyric acid
  MOD_RES (20)..(20): C-terminal amidation
FQSKPNVHLDCYACRLXAKL

SEQ ID NO: 4216 - protein, 20 aa, Artificial Sequence
  Synthetic peptide
  MOD_RES (1)..(1): N-terminal acetylation
  MOD_RES (5)..(5): D-Pro
  MOD_RES (6)..(6): Xaa is 3-(Acetylamino-methylsulfanyl)-2-amino-propionic acid
  MOD_RES (9)..(9): Tert-Leu
  MOD_RES (11)..(11): D-Cys
  MISC_FEATURE (11)..(14): D-Cys and Homo-Cys linked via disulfide bond
  MOD_RES (13)..(13): Benzothienyl-Ala
  MOD_RES (14)..(14): Homo-Cys
  MOD_RES (17)..(17): Xaa is 2-amino-isobutyric acid
  MOD_RES (20)..(20): C-terminal amidation
FQSKPXVHLDCYACRLXAKL

SEQ ID NO: 4217 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-ethylmaleiimido Cys
  MOD_RES (9)..(9): Tert-Leu
  MOD_RES (11)..(11): D-Ala
  MOD_RES (13)..(13): Benzothienyl-Ala
  MOD_RES (17)..(17): Xaa is 2-amino-isobutyric acid
  MOD_RES (20)..(20): C-terminal amidation
FQSKPCVHLDAYAERLXAKL

SEQ ID NO: 4218 - protein, 20 aa, Artificial Sequence
  Synthetic peptide
  MOD_RES (1)..(1): N-terminal acetylation
  MOD_RES (5)..(5): D-Pro
  MOD_RES (6)..(6): N-ethylmaleiimido Cys
  MOD_RES (11)..(11): D-Ala
  MOD_RES (13)..(13): Benzothienyl-Ala
  MOD_RES (17)..(17): Xaa is 2-amino-isobutyric acid
  MOD_RES (20)..(20): C-terminal amidation
FQSKPCVHVPAYAERLXAKL

SEQ ID NO: 4219 - protein, 20 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (16)..(16): Alpha-methyl-Leu
  MOD_RES (17)..(17): Xaa is 2-amino-isobutyric acid
  MOD_RES (20)..(20): C-terminal amidation
FQSKPNVHLDAYFERLXAKL

SEQ ID NO: 4220 - protein, 20 aa, Artificial Sequence
  Synthetic peptide
  MOD_RES (1)..(1): N-terminal acetylation
  MOD_RES (5)..(5): D-Pro
  MOD_RES (6)..(6): Xaa is 2-Amino-3-(2-carbamoyl-ethylsulfanyl)-propionic acid
  MOD_RES (11)..(11): D-Ala
  MOD_RES (17)..(17): Xaa is 2-amino-isobutyric acid
  MOD_RES (20)..(20): C-terminal amidation
FQSKPXVHVPAYFERLXAKL

SEQ ID NO: 4221 - protein, 20 aa, Artificial Sequence
  Synthetic peptide
  MOD_RES (1)..(1): N-terminal acetylation
  MOD_RES (5)..(5): D-Pro
  MOD_RES (6)..(6): Cys(5-methylen-2-oxazolidinon)
  MOD_RES (11)..(11): D-Ala
  MOD_RES (17)..(17): Xaa is 2-amino-isobutyric acid
  MOD_RES (20)..(20): C-terminal amidation
FQSKPCVHVPAYFERLXAKL

SEQ ID NO: 4222 - protein, 20 aa, Artificial Sequence
  Synthetic peptide
  MOD_RES (1)..(1): N-terminal acetylation
  MOD_RES (5)..(5): D-Pro
  MOD_RES (6)..(6): Cys(1-methylen-1H-benzotriazol)
  MOD_RES (11)..(11): D-Ala
  MOD_RES (17)..(17): Xaa is 2-amino-isobutyric acid
  MOD_RES (20)..(20): C-terminal amidation
FQSKPCVHVPAYFERLXAKL

SEQ ID NO: 4223 - protein, 20 aa, Artificial Sequence
  Synthetic peptide
  MOD_RES (1)..(1): N-terminal acetylation
  MOD_RES (5)..(5): D-Pro
  MOD_RES (6)..(6): Cys(3-methylen-2-benzothiazolinon)
  MOD_RES (11)..(11): D-Ala
  MOD_RES (17)..(17): Xaa is 2-amino-isobutryic acid
  MOD_RES (20)..(20): C-terminal amidation
FQSKPCVHVPAYFERLXAKL

SEQ ID NO: 4224 - protein, 20 aa, Artificial Sequence
  Synthetic peptide
  MOD_RES (1)..(1): N-terminal acetylation
  MOD_RES (5)..(5): D-Pro
  MOD_RES (6)..(6): 4-nitrophenyl-Ala
  MOD_RES (11)..(11): D-Ala
  MOD_RES (17)..(17): Xaa is 2-amino-isobutyric acid
  MOD_RES (20)..(20): C-terminal amidation
FQSKPFVHVPAYFERLXAKL

SEQ ID NO: 4225 - protein, 20 aa, Artificial Sequence
  Synthetic peptide
  MOD_RES (1)..(1): N-terminal acetylation
  MOD_RES (5)..(5): D-Pro
  MOD_RES (6)..(6): N(omega)-nitro-L-Arg
  MOD_RES (11)..(11): D-Ala
  MOD_RES (17)..(17): Xaa is 2-amino-isobutyric acid
  MOD_RES (20)..(20): C-terminal amidation
FQSKPRVHVPAYFERLXAKL

SEQ ID NO: 4226 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (13)..(13): Benzothienyl-Ala
  MOD_RES (17)..(17): Xaa is 2-amino-isobutyric acid
  MOD_RES (18)..(18): D-Cys
  MISC_FEATURE (18)..(21): D-Cys and 2-Amino-ethanethiol linked via disulfide bond
  MOD_RES (21)..(21): Xaa is 2-Amino-ethanethiol
FQSKPNVHLDAYAERLXCKLX

SEQ ID NO: 4227 - protein, 21 aa, Artificial Sequence
  Synthetic peptide
  MOD_RES (1)..(1): N-terminal acetylation
  MOD_RES (5)..(5): D-Pro
  MOD_RES (6)..(6): 3-(Acetylamino-methylsulfanyl)-2-amino-propionic acid
  MOD_RES (9)..(9): Tert-Leu
  MOD_RES (11)..(11): D-Ala
  MOD_RES (13)..(13): Benzothienyl-Ala
  MOD_RES (17)..(17): Xaa is 2-amino-isobutyric acid
  MOD_RES (18)..(18): D-Cys
  MISC_FEATURE (18)..(21): D-Cys and 2-Amino-ethanethiol linked via disulfide bond
  MOD_RES (21)..(21): Xaa is 2-Amino-ethanethiol
FQSKPCVHLDAYAERLXCKLX

SEQ ID NO: 4228 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (18)..(18): Homo-Cys
  MISC_FEATURE (18)..(21): Homo-Cys and 2-Amino-ethanethiol linked via disulfide bond
  MOD_RES (21)..(21): Xaa is 2-Amino-ethanethiol
FQSKPNVHLDAYFERLXCKLX

SEQ ID NO: 4229 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (18)..(18): D-Cys
  MISC_FEATURE (18)..(21): D-Cys and Homo-Cys linked via disulfide bond
  MOD_RES (21)..(21): Homo-Cys
  MOD_RES (21)..(21): C-terminal amidation
FQSKPNVHLDAYFERLXCKLC

SEQ ID NO: 4230 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (18)..(18): D-Cys
  MISC_FEATURE (18)..(21): D-Cys and Cys linked via disulfide bond
  MOD_RES (21)..(21): C-terminal amidation
FQSKPNVHLDAYFERLXCKLC

SEQ ID NO: 4231 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (18)..(18): D-Cys
  MISC_FEATURE (18)..(21): D-Cys linked via disulfide bond
  MOD_RES (21)..(21): D-Cys
  MOD_RES (21)..(21): C-terminal amidation
FQSKPNVHLDAYFERLXCKLC

SEQ ID NO: 4232 - protein, 21 aa, Artificial Sequence
  Synthetic peptide
  MOD_RES (1)..(1): N-terminal acetylation
  MOD_RES (5)..(5): D-Pro
  MOD_RES (11)..(11): D-Ala
  MOD_RES (13)..(13): Benzothienyl-Ala
  MOD_RES (17)..(17): Xaa is 2-amino-isobutyric acid
  MOD_RES (18)..(18): D-Cys
  MISC_FEATURE (18)..(21): D-Cys and 2-Amino-ethanethiol linked via disulfide bond
  MOD_RES (21)..(21): Xaa is 2-Amino-ethanethiol
FQSKPNVHVPAYAERLXCKLX

SEQ ID NO: 4233 - protein, 20 aa, Artificial Sequence
  Synthetic peptide
  MOD_RES (1)..(1): N-terminal acetylation
  MOD_RES (5)..(5): D-Pro
  MOD_RES (11)..(11): D-Cys
  MISC_FEATURE (11)..(14): D-Cys and Homo-Cys linked via disulfide bond
  MOD_RES (13)..(13): Benzothienyl-Ala
  MOD_RES (14)..(14): Homo-Cys
  MOD_RES (17)..(17): Xaa is 2-amino-isobutyric acid
  MOD_RES (20)..(20): C-terminal amidation
FQSKPNVHVPCYACRLXAKL

SEQ ID NO: 4234 - protein, 80 aa, Homo sapiens
  MISC_FEATURE (26)..(75): KD1 Sequence
DSEEDEEHTIITDTELPPLKLMHSFCAFKADDGPCKAIMKRFFFNIFTRQCEEFIGGCEGNQNRFESLEECKKMCTRDNA

SEQ ID NO: 4235 - protein, 152 aa, Homo sapiens
  MISC_FEATURE (28)..(78): KD1 Sequence
  MISC_FEATURE (86)..(91): TFPI linker sequence
  MISC_FEATURE (99)..(149): KD2 sequence
MADSEEDEEHTIITDTELPPLKLMHSFCAFKADDGPCKAIMKRFFFNIFTRQCEEFIYGGCEGNQNRFESLEECKKMCTRDNANRLVPRGSQQEKPDFCFLEEDPGICRGYITRYFYNNQTKQCERFKYGGCLGNMNNFETLEECKNICEDG

SEQ ID NO: 4236 - protein, 88 aa, Homo sapiens
  MISC_FEATURE (28)..(77): KD1 Sequence
MADSEEDEEHTIITDTELPPLKLMHSFCAFKADDGPCKAIMKRFFFNIFTRQCEEFIGGCEGNQNRFESLEECKKMCTRDNANRLVPR

SEQ ID NO: 4237 - protein, 63 aa, Homo sapiens
  MISC_FEATURE (10)..(60): KD2 sequence
GSQQEKPDFCFLEEDPGICRGYITRYFYNNQTKQCERFKYGGCLGNMNNFETLEECKNICEDG

SEQ ID NO: 4238 - protein, 20 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (20)..(20): C-terminal amidation
FQSKPCVHVDGYFERLXAKL

SEQ ID NO: 4239 - protein, 20 aa, Artificial Sequence
  Synthetic peptide
  MOD_RES (1)..(1): N-terminal acetylation
  MOD_RES (5)..(5): D-Pro
  MOD_RES (8)..(8): 1-naphtyl-Ala
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPNVALDAYFERLXAKL

SEQ ID NO: 4240 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (13)..(13): C-terminal amidation
  MOD_RES (17)..(17): Xaa is 2-amino-isobutyric acid
  MOD_RES (21)..(21): Lys((N-(3-{2-[2-(3-Amino-propoxy)-ethoxy]-ethoxy}-propyl)-succina mic acid)-3-maleiimidopropionyl)-OH
FQSKPNVHLDAYFERLXAKLK

SEQ ID NO: 4241 - protein, 21 aa, Artificial Sequence
  Synthetic peptide
  MOD_RES (1)..(1): N-terminal acetylation
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys is covalently bound to N-(3-{2-[2-(3-Amino-propoxy)-ethoxy]-ethoxy}-propyl)-succinamic acid-Maleimidopropionyl(EtSH)
  MOD_RES (21)..(21): C-terminal amidation
FQSKPNVHLDAYFERLXAKLK

SEQ ID NO: 4242 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Amidation
  MOD_RES (21)..(21): Cys is covalently bound to SEQ ID NO: 4077 via 1,6-Bis-maleiimido-hexane (M2Hex) linker to form a dimer
FQSKPNVHVDGYFERLXAKLC

SEQ ID NO: 4243 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Amidation
  MOD_RES (21)..(21): Cys is covalently bound to SEQ ID NO: 4077 via bismaleiimido-diamino-4,7,10-trioxatridecane (M2Trio) linker to form a dimer
FQSKPNVHVDGYFERLXAKLC

SEQ ID NO: 4244 - protein, 21 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  MOD_RES (21)..(21): Amidation
  MOD_RES (21)..(21): Cys is covalently bound to SEQ ID NO: 4077 via bis-maleiimido-PEG2000 (M2PEG2000) linker to form a dimer
FQSKPNVHVDGYFERLXAKLC

SEQ ID NO: 4245 - protein, 20 aa, Artificial Sequence
  Synthetic peptide
  MOD_RES (1)..(1): N-terminal acetylation
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPCVHLDAYFERLXAKL

SEQ ID NO: 4246 - protein, 20 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPCVHLDAYFERLXAKL

SEQ ID NO: 4247 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): C-terminal amidation
FQSKPCVHLDAYFERLXAKLC

SEQ ID NO: 4248 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-(myristyl-Ttds))
  MOD_RES (21)..(21): C-terminal amidation
FQSKPCVHLDAYFERLXAKLK

SEQ ID NO: 4249 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-(palmityl-Ttds))
  MOD_RES (21)..(21): C-terminal amidation
FQSKPCVHLDAYFERLXAKLK

SEQ ID NO: 4250 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Amidation
  MOD_RES (21)..(21): Cys is covalently bound to SEQ ID NO: 4249 via bismaleiimido-diamino-4,7,10-trioxatridecane (M2Trio) linker to form a dimer
FQSKPCVHLDAYFERLXAKLC

SEQ ID NO: 4251 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Cys-PEG (ME-400MA)
  MOD_RES (21)..(21): C-terminal amidation
FQSKPCVHLDAYFERLXAKLC

SEQ ID NO: 4252 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPCVHLDAYFERLXAKLC

SEQ ID NO: 4253 - protein, 22 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Xaa is (13-amino-4,7,10-trioxa-tridecayl)-succinamic acid (Ttds)
  MOD_RES (22)..(22): Lys(epsilon-(myristyl-Ttds)
  MOD_RES (22)..(22): C-terminal amidation
FQSKPCVHLDAYFERLXAKLXK

SEQ ID NO: 4254 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-acetyl-Ttds)
  MOD_RES (21)..(21): C-terminal amidation
FQSKPCVHLDAYFERLXAKLK

SEQ ID NO: 4255 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-myristyl-gamma-glutamyl-Ttds)
  MOD_RES (21)..(21): C-terminal amidation
FQSKPCVHLDAYFERLXAKLK

SEQ ID NO: 4256 - protein, 19 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
FQSKPCVHLDAYFERLXAK

SEQ ID NO: 4257 - protein, 21 aa, Artificial Sequence
  Synthetic peptide
  MOD_RES (1)..(1): N-terminal hexanoyl
  MOD_RES (5)..(5): D-Pro
  MOD_RES (6)..(6): Cys(3-(Acetylamino-methylsulfanyl)-2-amino-propionic acid)
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Cys is covalently bound to mPEG23 via maleiimide linker
  MOD_RES (21)..(21): C-terminal amidation
FQSKPCVHLDAYFERLXAKLC

SEQ ID NO: 4258 - protein, 21 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is (S)-2-Amino-pentanoic acid
  MOD_RES (21)..(21): C-terminal amidation
FQSKPSVHLDAYFERLXAKLC

SEQ ID NO: 4259 - protein, 21 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): N-ethylmaleiimido Cys
  MOD_RES (21)..(21): C-terminal amidation
FQSKPSVHLDAYFERLXAKLC

SEQ ID NO: 4260 - protein, 53 aa, Artificial Sequence
  Synthetic peptide
  MOD_RES (1)..(1): N-terminal acetylation
  MOD_RES (5)..(5): D-Pro
  MOD_RES (17)..(17): Xaa is 2-amino-isobutyric acid
  DISULFID (37)..(48): Cys residues linked via disulfide bond
  MOD_RES (53)..(53): C-terminal amidation
FQSKPNVHVDGYFERLXAKLSSSSSSSSSSSYYKWHCAMRDMKGTMTCVWVKF

SEQ ID NO: 4261 - protein, 20 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPSVHLDAYFERLXAKL

SEQ ID NO: 4262 - protein, 21 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-myristyl)
  MOD_RES (21)..(21): C-terminal amidation
FQSKPSVHLDAYFERLXAKLK

SEQ ID NO: 4263 - protein, 20 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (14)..(14): Lys(epsilon-myristyl)
  MOD_RES (17)..(17): Xaa is 2-amino-isobutyric acid
  MOD_RES (20)..(20): C-terminal amidation
FQSKPSVHLDAYFKRLXAKL

SEQ ID NO: 4264 - protein, 20 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (10)..(10): Lys(epsilon-myristyl)
  MOD_RES (11)..(11): D-Ala
  MOD_RES (17)..(17): Xaa is 2-amino-isobutyric acid
  MOD_RES (20)..(20): C-terminal amidation
FQSKPSVHLKAYFERLXAKL

SEQ ID NO: 4265 - protein, 20 aa, Artificial Sequence
  Synthetic peptide
  MOD_RES (1)..(1): N-terminal hexanoyl
  MOD_RES (5)..(5): D-Pro
  MOD_RES (6)..(6): Lys(epsilon-myristyl)
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPKVHLDAYFERLXAKL

SEQ ID NO: 4266 - protein, 20 aa, Artificial Sequence
  Synthetic peptide
  MOD_RES (1)..(1): N-terminal hexanoyl
  MOD_RES (4)..(4): Lys(epsilon-myristyl)
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (20)..(20): C-terminal amidation
FQSKPSVHLDAYFERLXAKL

SEQ ID NO: 4267 - protein, 21 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-4-(p-iodophenyl)butyryl))
  MOD_RES (21)..(21): C-terminal amidation
FQSKPSVHLDAYFERLXAKLK

SEQ ID NO: 4268 - protein, 21 aa, Artificial Sequence
  Synthetic peptide
  MOD_RES (1)..(1): N-terminal hexanoyl
  MOD_RES (5)..(5): D-Pro
  MOD_RES (9)..(9): Tert-Leu
  MOD_RES (11)..(11): D-Ala
  MOD_RES (17)..(17): Xaa is 2-amino-isobutyric acid
  MOD_RES (21)..(21): Lys(epsilon-4-(pentyl)-benzolsulfonamidyl)
  MOD_RES (21)..(21): C-terminal amidation
FQSKPSVHLDAYFERLXAKLK

What is claimed:

1. A peptide complex comprising a first peptide and a second peptide, wherein
   (a) the first peptide comprises the structure of formula (XIII)
   X6001-X6002-X6003-X6004-X6005-X6006-X6007-X6008-X6009-X6010-X6011-X6012-X6013-X6014-X6015-X6016-X6017-X6018-X6019-X6020 (XIII) (SEQ ID NO: 3153);
   wherein X6001 is an amino acid selected from the group consisting of F, L, M, Y, 1Ni, Thi, Bta, Dopa, Bhf, C, D, G, H, I, K, N, Nmf, Q, R, T, V, and W;
   wherein X6002 is an amino acid selected from the group consisting of Q, G, and K;
   wherein X6003 is an amino acid selected from the group consisting of C, D, E, M, Q, R, S, T, Ede(O), Cmc, A, Aib, Bhs, F, G, H, I, K, L, N, P, V, W and Y;
   wherein X6004 is an amino acid selected from the group consisting of Aib, E, G, I, K, L, M, P, R, W, Y, A, Bhk, C, D, F, H, k, N, Nmk, Q, S, T and V;
   wherein X6005 is an amino acid selected from the group consisting of a, A, Aib, C, D, d, E, G, H, K, k, M, N, Nmg, p, Q, R, NpropylG, aze, pip, tic, oic, hyp, nma, Ncg, Abg, Apg, thz, dtc, Bal, F, L, S, T, V, W and Y;
   wherein X6006 is an amino acid selected from the group consisting of A, C, C(NEM), D, E, G, H, K, M, N, Q, R, S, V, Cit, C(Acm), Nle, I, Ede(O), Cmc, Ed, Eea, Eec, Eef, Nif, Eew, Aib, Btq, F, L, T, W and Y;
   wherein X6007 is an amino acid selected from the group consisting of I, V, T, Chg, Phg, Tle, A, F, G, K, L, Nmv, P, Q, S, W and Y;
   wherein X6008 is an amino acid selected from the group consisting of F, H, 1Ni, 2Ni, Pmy, Y, and W;
   wherein X6009 is an amino acid selected from the group consisting of Aib, V, Chg, Phg, Abu, Cpg, Tle, L-2-amino-4,4,4-trifluorobutyric acid, A, f, I, K, S, T and V;
   wherein X6010 is an amino acid selected from the group consisting of A, C, D, d, E, F, H, K, M, N, P, Q, R, S, T, V, W, Y, Nmd, C(NEM), Aib, G, I, L and Nmf;
   wherein X6011 is an amino acid selected from the group consisting of A, a, p, Sar, c, hcy, Aib, C, K, and Nmg;
   wherein X6012 is an amino acid selected from the group consisting of Y, Tym, Pty, Dopa and Pmy;
   wherein X6013 is an amino acid selected from the group consisting of Aib, C, F, 1Ni, Thi, Bta, A, E, G, H, K, L, M, Q, R, W and Y;
   wherein X6014 is an amino acid selected from the group consisting of A, Aib, C, C(NEM), D, E, K, L, M, N, Q, R, T, V, Hcy, Bhe, F, G, H, I, P, S, W and Y;
   wherein X6015 is an amino acid selected from the group consisting of R, (omega-methyl)-R, D, E and K;
   wherein X6016 is an amino acid selected from the group consisting of L, Hcy, Hle and Aml;

wherein X6017 is an amino acid selected from the group consisting of A, a, Aib, C, c, Cha, Dab, Eag, Eew, H, Har, Hci, Hle, I, K, L, M, Nle, Nva, Opa, Orn, R, S, Deg, Ebc, Eca, Egz, Aic, Apc, Egt, (omega-methyl)-R, Bhr, Cit, D, Dap, E, F, G, N, Q, T, V, W and Y;

wherein X6018 is an amino acid selected from the group consisting of A, Aib, Hcy, hcy, C, c, L, Nle, M, N, R, Bal, D, E, F, G, H, I, K, Q, S, T, V, W and Y;

wherein X6019 is an amino acid selected from the group consisting of K, R, Har, Bhk and V; and wherein X6020 is an amino acid selected from the group consisting of K, L, Hcy, Ami, Aib, Bhl, C, F, G, H, I, Nml, Q, R, S, T, V, W and Y and (b) the second peptide comprises the structure of formula (XIV):

X7001-X7002-X7003-X7004-X7005-X7006-[X7007-X7008-X7009-X7010-X7011-X7012-X7013-X7014-X7015-X7016-X7017-X7018]-X7019-X7020-X7021-X7022-X7023 (XIV) (SEQ ID NO: 3154), wherein X7001 is either present or absent, whereby in case X7001 is present it is an amino acid selected from the group consisting of A, C, C(NEM), D, E, F, G, H, I, K, L, P, R, S, T, V and W;

wherein X7002 is either present or absent, whereby in case X7002 is present it is an amino acid selected from the group consisting of A, C, C(NEM), D, E, F, G, H, I, K, L, M, P, Q, R, S, T, V, W and Y;

wherein X7003 is an amino acid selected from the group consisting of A, F, I, K, L, R, S, T, V, W and Y;

wherein X7004 is an amino acid selected from the group consisting of A, D, E, F, G, I, K, L, R, S, T, V and W;

wherein X7005 is R or W;

wherein X7006 is an amino acid selected from the group consisting of F, H, I, K, L, R, V and W;

wherein X7007 is an amino acid selected from the group consisting of Orn, homoK, C, Hcy, Dap and K;

wherein X7008 is an amino acid selected from the group consisting of A, G, R, S and T;

wherein X7009 is an amino acid selected from the group consisting of a, A, I, K, L, M, m, Moo, Nle, p, R, Sem and V;

wherein X7010 is an amino acid selected from the group consisting of A, G, I, K, L, P, R, S, T and V;

wherein X7011 is an amino acid selected from the group consisting of D, E, G, S and T;

wherein X7012 is an amino acid selected from the group consisting of A, a, D, d, E, e, F, f, G, I, K, k, L, 1, M, m, Moo, Nle, nle, P, p, R, r, S, s, Sem, T, t, V, v, W and w;

wherein X7013 is an amino acid selected from the group consisting of A, C, C(NEM), Con, Con(Meox), D, d, E, e, Eag, F, G, I, K, L, N, R, S, s, T, V and W;

wherein X7014 is an amino acid selected from the group consisting of A, D, E, F, G, I, K, L, M, R, S, T, V and W;

wherein X7015 is an amino acid selected from the group consisting of A, D, E, F, G, I, K, L, M, Nle, R, S, T, V and W;

wherein X7016 is an amino acid selected from the group consisting of A, D, E, F, I, K, L, M, Moo, Nle, R, S, Sem, T, V, W and Y;

wherein X7017 is an amino acid selected from the group consisting of A, D, E, F, G, I, K, L, R, S, T, V, W and Y;

wherein X7018 is an amino acid selected from the group consisting of C and D;

wherein X7019 is an amino acid selected from the group consisting of A, F, I, L, S, T, V and W;

wherein X7020 is an amino acid selected from the group consisting of F and W;

wherein X7021 is an amino acid selected from the group consisting of I, L and V;

wherein X7022 is an amino acid selected from the group consisting of A, D, E, F, G, I, K, L, P, R, S, T, V and W;

wherein X7023 is either present or absent, whereby in case X7023 is present it is an amino acid selected from the group consisting of A, C, C(NEM), Con, Con(Meox), D, E, Eag, F, G, I, K, L, R, S, T, V, W and Y;

wherein the peptide comprises as a cyclic structure generated by a linkage between X7007 and X7018; and wherein the C-terminus of the first peptide is linked to the N-terminus of the second peptide via a linker moiety.

2. The peptide complex of claim 1, wherein wherein X6001 is an amino acid selected from the group consisting of 1Ni, Bta, Dopa, F, L, Y and M;

wherein X6002 is Q;

wherein X6003 is an amino acid selected from the group consisting of D, E, S, M, Q, R, T and C;

wherein X6004 is an amino acid selected from the group consisting of K, Aib, L, P, R, E, G, I, Y, M and W;

wherein X6005 is an amino acid selected from the group consisting of p, Nmg, NpropylG, aze, pip, tic, oic, hyp, a, Aib, D, d, G, H, K, k, N, Q, R, A, E, C and M;

wherein X6006 is an amino acid selected from the group consisting of C, E, K, R, S, V, C(Acm), Nle, C(NEM), I, Cit, A, D, G, H, Q and M;

wherein X6007 is an amino acid selected from the group consisting of Tle, V and I;

wherein X6008 is an amino acid selected from the group consisting of H, 1Ni, 2Ni, Pmy, F and Y;

wherein X6009 is V, Abu or Tle;

wherein X6010 is an amino acid selected from the group consisting of D, P, C, T, A, E, K, M, N, Q, R, F, H, S, V, W and Y;

wherein X6011 is an amino acid selected from the group consisting of G, a, c, hcy and Sar;

wherein X6012 is Y;

wherein X6013 is an amino acid selected from the group consisting of F, 1Ni, Bta and C;

wherein X6014 is an amino acid selected from the group consisting of Aib, C, E, Hcy, A, D, K, L, M, N, Q, R, T, V and Aib;

wherein X6015 is R;

wherein X6016 is an amino acid selected from the group consisting of L, Aml, Hle and Hcy;

wherein X6017 is an amino acid selected from the group consisting of A, Aib, C, c, Aic, Eca, Deg, Cha, Dab, Dap, Eag, Eew, H, Har, Hci, Hle, K, Nle, Nva, Opa, Orn, R, I, L, S and M;

wherein X6018 is an amino acid selected from the group consisting of A, Aib, C, c, L, Hcy, N, M and R;

wherein X6019 is K; and wherein X6020 is an amino acid selected from the group consisting of L, Aml, Hcy and K.

3. The peptide complex of claim 1, wherein X7001 is an amino acid selected from the group consisting of A, D, F, G, H, K, L and S;

wherein X7002 is an amino acid selected from the group consisting of H, F, M and R;

wherein X7003 is an amino acid selected from the group consisting of F and Y;

wherein X7004 is K;

wherein X7005 is W;

wherein X7006 is an amino acid selected from the group consisting of F and H;

wherein X7007 is C;

wherein X7008 is an amino acid selected from the group consisting of A, G and S;
wherein X7009 is an amino acid selected from the group consisting of M, Sem and V;
wherein X7010 is an amino acid selected from the group consisting of K, P and R;
wherein X7011 is D;
wherein X7012 is an amino acid selected from the group consisting of F, L, 1, M and Sem;
wherein X7013 is an amino acid selected from the group consisting of D, G, K and S;
wherein X7014 is G;
wherein X7015 is an amino acid selected from the group consisting of I and T;
wherein X7016 is an amino acid selected from the group consisting of D, F, M, Sem and Y;
wherein X7017 is an amino acid selected from the group consisting of S and T;
wherein X7018 is C;
wherein X7019 is an amino acid selected from the group consisting of A and V;
wherein X7020 is W;
wherein X7021 is V;
wherein X7022 is an amino acid selected from the group consisting of F, L, K, R, P and W;
wherein X7023 is either present or absent, whereby in case X7023 is present it is an amino acid sequence selected from the group consisting of A, D, F, M, S and Y; and
wherein the peptide comprises a cyclic structure generated by a linkage between X7007 and X7018.

4. The peptide complex of claim 1, wherein the linker moiety is about 5-50 Å in length.

5. The peptide complex of claim 4, wherein the linker moiety is about 10-30 Å in length.

6. The peptide complex of claim 1, wherein the linker moiety comprises the structure $Z_{1\text{-}20}$, wherein Z is an amino acid, hydroxy acid, ethylene glycol, propylene glycol, or a combination of any of the foregoing.

7. The peptide complex of claim 6, wherein Z is G, s, S, a, A, Bal, Gaba, Ahx, Ttds, or a combination of any of the foregoing.

8. The peptide complex of claim 1, wherein the linker moiety is attached to the first peptide and/or the second peptide via an oxime, a hydrazide, a succinimide, a thioether, a triazole, a secondary amine, an amide, or a disulfide.

9. The peptide complex of claim 1, wherein the amino acid sequence of the first peptide is at least 80% identical to SEQ ID NO: 178 or SEQ ID NO: 4261.

10. The peptide complex of claim 1, wherein the amino acid sequence of the second peptide is at least 80% identical to SEQ ID NO: 1044.

11. The peptide complex of claim 1 comprising the amino acid sequence set forth in SEQ ID NO: 4260.

12. A pharmaceutical composition comprising the peptide complex of claim 1 and a pharmaceutically acceptable carrier.

13. A peptide consisting of the amino acid sequence selected from the group consisting of SEQ ID NOs: 1337-1355 4240-4241 and 4245-4268.

14. The peptide complex of claim 1, wherein the linker moiety is about 1-100 Å in length.

15. The peptide complex of claim 2,
wherein X7001 is an amino acid selected from the group consisting of A, D, F, G, H, K, L and S;
wherein X7002 is an amino acid selected from the group consisting of H, F, Y, M and R;
wherein X7003 is an amino acid selected from the group consisting of F and Y;
wherein X7004 is K;
wherein X7005 is W;
wherein X7006 is an amino acid selected from the group consisting of F and H;
wherein X7007 is C;
wherein X7008 is an amino acid selected from the group consisting of A, G and S;
wherein X7009 is an amino acid selected from the group consisting of M, Moo, Sem and V;
wherein X7010 is an amino acid selected from the group consisting of K, P and R;
wherein X7011 is D;
wherein X7012 is an amino acid selected from the group consisting of F, L, 1, M and Sem;
wherein X7013 is an amino acid selected from the group consisting of D, G, K and S;
wherein X7014 is G;
wherein X7015 is an amino acid selected from the group consisting of I and T;
wherein X7016 is an amino acid selected from the group consisting of D, F, M, Sem and Y;
wherein X7017 is an amino acid selected from the group consisting of S and T;
wherein X7018 is C;
wherein X7019 is an amino acid selected from the group consisting of A and V;
wherein X7020 is W;
wherein X7021 is V;
wherein X7022 is an amino acid selected from the group consisting of F, L, K, R, P and W;
wherein X7023 is either present or absent, whereby in case X7023 is present it is an amino acid sequence selected from the group consisting of A, D, F, M, S and Y; and
wherein the peptide comprises a cyclic structure generated by a linkage between X7007 and X7018.

16. The peptide complex of claim 15, wherein the first peptide comprises an amino acid sequence at least 80% identical to SEQ ID NO: 178 or SEQ ID NO: 4261.

17. The peptide complex of claim 16, wherein the first peptide comprises SEQ ID NO: 4261.

18. The peptide complex of claim 16, wherein the second peptide comprises an amino acid sequence at least 80% identical to SEQ ID NO: 1044.

19. The peptide complex of claim 17, wherein the second peptide comprises an amino acid sequence at least 80% identical to SEQ ID NO: 1044.

20. The peptide complex of claim 17, wherein the second peptide comprises SEQ ID NO: 1334.

21. A method for treating a subject suffering from a disease wherein the disease is a blood coagulation disorder or being at risk of suffering from a disease, the method comprising administering to the subject a pharmaceutical composition of claim 12.

* * * * *